(12) United States Patent
Levine et al.

(10) Patent No.: US 6,936,450 B2
(45) Date of Patent: Aug. 30, 2005

(54) VARIANTS OF PROTEIN KINASES

(75) Inventors: Zurit Levine, Herzliya (IL); Jeanne Bernstein, Kfar Yona (IL)

(73) Assignee: Compugen Ltd., Tel Aviv (IL)

( * ) Notice: Subject to any disclaimer, the term of this patent is extended or adjusted under 35 U.S.C. 154(b) by 496 days.

(21) Appl. No.: 09/771,161

(22) Filed: Jan. 26, 2001

(65) Prior Publication Data

US 2002/0110811 A1 Aug. 15, 2002

Related U.S. Application Data

(63) Continuation-in-part of application No. 09/724,676, filed on Nov. 28, 2000.

(51) Int. Cl.[7] .......................... C12N 9/12; C07K 14/00; A61K 38/10
(52) U.S. Cl. ..................... 435/194; 530/350; 424/94.6
(58) Field of Search ...................... 435/194; 530/350; 424/94.6

(56) References Cited

FOREIGN PATENT DOCUMENTS

| WO | WO 98/55507 | * 12/1998 | ........... C07K/14/00 |
|---|---|---|---|
| WO | WO 99/40102 | * 8/1999 | ........... C07K/14/00 |

OTHER PUBLICATIONS

Inohara et al Rick, a novel protein kinase containing a caspase recruitment domain, interacts with CLARP and regulates CD95–mediated apoptosis. J Biol Chem. May 15, 1998;273(20):12296–300.*

Gelfand et al. (1999) "ASDB: database of alternatively spliced genes" Nucl. Acids Res. 27:301–2.

Smith et al. (1989) "Alternative splicing in the control of gene expression" Annu. Rev. Genet. 23:527–77.

Breibart et al. (1987) "Alternative Splicing: A ubiquitous mechanism for the generation of multiple protein isoforms from single genes" Ann. Rev. Biochem. 56:467–495.

Chabot (1996) "Directing alternative splicing cast and scenarios" Trends Genet. 12:472–8.

Stamm et al. (1994) "A sequence compilation and comparison of exons that are alternatively spliced in neurons" Nucl. Acids Res. 22:1515–26.

Sharp (1994) "Split genes and RNA splicing" Cell 77:805–15.

Takehito Ueyama et al.; Biochemical and Biophysical Research Communications; vol. 269, pp. 557–563 (2000).

Richard Ross; Growth Hormone & IGF Research, vol. 9; pp. 42–46; 1999.

* cited by examiner

*Primary Examiner*—Tekchand Saidha
*Assistant Examiner*—Sheridan Swope
(74) *Attorney, Agent, or Firm*—Birch, Stewart, Kolasch & Birch, LLP

(57) ABSTRACT

The present invention concerns nucleic acid sequences and amino acid sequences of dominant negative variants of kinases, i.e. of sequences which inhibit activity of kinases in a dominant manner. The invention also concerns pharmaceutical compositions and detection methods using these sequences.

3 Claims, 136 Drawing Sheets

```
  1 MPARRLLLLTLLLPGLGIFGSTSTVTLPETLLFVSTLDGSLHAVSKRTG   50
    ||||||||||||||||||||||||||||||||||||||||||||||||
  1 MPARRLLLLTLLLPGLGIFGSTSTVTLPETLLFVSTLDGSLHAVSKRTG   50

51 SIKWTLKEDPVLQVPTHVEEPAFLPDPNDGSLYTLGSKNNEGLTKLPFTI  100
    |||||||||||||||||||||||||||||||||||||||||||||||||
 51 SIKWTLKEDPVLQVPTHVEEPAFLPDPNDGSLYTLGSKNNEGLTKLPFTI  100

101 PELVQASPCRSSDGILYMGKKQDIWYVIDLLTGEKQQTLSSAFADSLCPS  150
    |||||||||||||||||||||||||||||||||||||||||||||||||
101 PELVQASPCRSSDGILYMGKKQDIWYVIDLLTGEKQQTLSSAFADSLCPS  150

151 TSLLYLGRTEYTITMYDTKTRELRWNATYFDYAASLPEDEGDYKMSHFVS  200
    |||||||||||||||||||||||||||||||||||||||||||||||||
151 TSLLYLGRTEYTITMYDTKTRELRWNATYFDYAASLPEDEGDYKMSHFVS  200

201 NGDGLVVTVDSESGDVLWIQNYASPVVAFYVWQREGLRKVMHINVAVETL  250
    |||||||||||||||||||||||||||||||||||||||||||||||||
201 NGDGLVVTVDSESGDVLWIQNYASPVVAFYVWQREGLRKVMHINVAVETL  250
```

FIG. 1

```
251 RYLTFMSGEVGRITKWKYPFPKETEAKSKLTPTLYVGKYSTSLYASPSMV 300
    |||||||||||||||||||||||||||||||||||||||||||||||||
251 RYLTFMSGEVGRITKWKYPFPKETEAKSKLTPTLYVGKYSTSLYASPSMV 300

301 HEGVAVVPRGSTLPLLEGPQTDGVTIGDKGECVITPSTDVKFDPGLKSKN 350
    |||||||||||||||||||||||||||||||||||||||||||||||||
301 HEGVAVVPRGSTLPLLEGPQTDGVTIGDKGECVITPSTDVKFDPGLKSKN 350

351 KLNYLRNYWLLIGHHETPLSASTKMLERFPNNLPKHRENVIPADSEKKSF 400
    |||||||||||||||||||||||||||||||||||||||||||||||||
351 KLNYLRNYWLLIGHHETPLSASTKMLERFPNNLPKHRENVIPADSEKKSF 400

401 EE..TLLQMTS 409
    ||  :|::::||
401 EEVINLVDQTS 411
```

FIG. 1 (CONT.¹)

```
  5 QLQSVSSAIHLCDKKMELSLNIPVNHGPQEESCGSSQLHENSGSPETSR  54
    :|||||||||||||||||||||||||||||||||||||||||||||||
313 KLQSVSSAIHLCDKKMELSLNIPVNHGPQEESCGSSQLHENSGSPETSR 362

55 SLPAPQDNDFLSRKAQDCYFMKLHHCPGNHSWDSTISGSQRAAFCDHKTT 104
    |||||||||||||||||||||||||||||||||||||||||||||||||
363 SLPAPQDNDFLSRKAQDCYFMKLHHCPGNHSWDSTISGSQRAAFCDHKTT 412

105 PCSSAIINPLSTAGNSERLQPGIAQQWIQSKREDIVNQMTEACLNQSLDA 154
    |||||||||||||||||||||||||||||||||||||||||||||||||
413 PCSSAIINPLSTAGNSERLQPGIAQQWIQSKREDIVNQMTEACLNQSLDA 462

155 LLSRDLIMKEDYELVSTKPTRTSKVRQLLDTTDIQGEEFAKVIVQKLKDN 204
    |||||||||||||||||||||||||||||||||||||||||||||||||
463 LLSRDLIMKEDYELVSTKPTRTSKVRQLLDTTDIQGEEFAKVIVQKLKDN 512

205 KQMGLQPYPEILVVSRSPSLNLLQNKSM 232
    ||||||||||||||||||||||||||||
513 KQMGLQPYPEILVVSRSPSLNLLQNKSM 540
```

FIG. 2

```
  1  MADLEAVLADVSYLMAMEKSKATPAARASKKILLPEPSIRSVMQKYLEDR  50
     ||||||||||||||||||||||||||||||||||||||||||||||||||
  1  MADLEAVLADVSYLMAMEKSKATPAARASKKILLPEPSIRSVMQKYLEDR  50

51  GEVTFEKIFSQKLGYLLFRDFCLNHLEEARPLVEFYEEIKKYEKLETEEE  100
     |||||||||||||||||||||||||||||||||||||||||||||||||
 51  GEVTFEKIFSQKLGYLLFRDFCLNHLEEARPLVEFYEEIKKYEKLETEEE  100

101  RVARSREIFDSYIMKELLACSHPFSKSATEHVQGHLGKKQVPPDLFQPYI  150
     |||||||||||||||||||||||||||||||||||||||||||||||||
101  RVARSREIFDSYIMKELLACSHPFSKSATEHVQGHLGKKQVPPDLFQPYI  150

151  EEICQNLRGDVFQKFIE  167
     |||||||||||||||||
151  EEICQNLRGDVFQKFIE  167
```

FIG. 3

```
  1 MGLVSSKKPDKEKPIKEKDKGQWSPLKVSAQDKDAPPLPPLVVFNHLTPP  50
    |||||||||||||||||||||||||||||||||||||||||||||||||
  1 MGLVSSKKPDKEKPIKEKDKGQWSPLKVSAQDKDAPPLPPLVVFNHLTPP  50

51 PPDEHLDEDKHFVVALYDYTAMNDRDLQMLKGEKLQVLKGTGDWWLARSL 100
    |||||||||||||||||||||||||||||||||||||||||||||||||
 51 PPDEHLDEDKHFVVALYDYTAMNDRDLQMLKGEKLQVLKGTGDWWLARSL 100

101 VTGREGYVPSNFVARVESLEMERWFFRSQGRKEAERQLLAPINKAGSFLI 150
    |||||||||||||||||||||||||||||||||||||||||||||||||
101 VTGREGYVPSNFVARVESLEMERWFFRSQGRKEAERQLLAPINKAGSFLI 150

151 RESETNKGAFSLSVKDVTTQGELIKHYKIRCLDEGGYYISPRITFPSLQA 200
    |||||||||||||||||||||||||||||||||||||||||||||||||
151 RESETNKGAFSLSVKDVTTQGELIKHYKIRCLDEGGYYISPRITFPSLQA 200

201 LVQHYS.......................................... 206
    ||||||
201 LVQHYSKKGDGLCQRLTLPCVRPAPQNPWAQDEWEIPRQSLRLVRKLGSG 250

207 .........SYYKNNMKVAIKTLKEGTMSPEAFLGEANVMKALQHERLVRLY 249
             |||||||||||||||||||||||||||||||||||||||||
251 QFGEVWMGYYKNNMKVAIKTLKEGTMSPEAFLGEANVMKALQHERLVRLY 300
```

FIG. 4

```
250 AVVTKEPIYIVTEYMARGCLLDFLKTDEGSRLSLPRLIDMSAQIAEGMAY 299
    |||||||||||||||||||||||||||||||||||||||||||||||||
301 AVVTKEPIYIVTEYMARGCLLDFLKTDEGSRLSLPRLIDMSAQIAEGMAY 350

300 IERMNSIHRDLRAANILVSEALCCKIADFGLARIIDSEYTAQEGAKFPIK 349
    |||||||||||||||||||||||||||||||||||||||||||||||||
351 IERMNSIHRDLRAANILVSEALCCKIADFGLARIIDSEYTAQEGAKFPIK 400

350 WTAPEAIHFGVFTIKADVWSFGVLLMEVVTYGRVPYPGMSNPEVIRNLER 399
    ||||||| |||||||||||||||||||||||||||||||||||||||||
401 WTAPEAYHFGVFTIKADVWSFGVLLMEVVTYGRVPYPGMSNPEVIRNLER 450

400 GYRMPRPDTCPPELYRGVIAECWRSRPEERPTFEFLQSVLEDFYTATERQ 449
    |||||||||||||||||||||||||||||||||||||||||||||||||
451 GYRMPRPDTCPPELYRGVIAECWRSRPEERPTFEFLQSVLEDFYTATERQ 500
```

450 YELQP 454
    |||||
501 YELQP 505

FIG. 4 (CONT.¹)

```
1  MENFQKVEKIGEGTYGVVYKARNKLTGEVVALKKIRLDTETEGVPSTAIR  50
   |||||||||||||||||||||||||||||||||||||||||||||||||
1  MENFQKVEKIGEGTYGVVYKARNKLTGEVVALKKIRLDTETEGVPSTAIR  50

51 EISLLKELNHPNIVKLLDVIHTENK  75
   |||||||||||||||||||||||||
51 EISLLKELNHPNIVKLLDVIHTENK  75
```

FIG. 5

```
  1 MTRDEALPDSHSAQDFYENYEPKEILGRGVSSVVRRCIHKPTSQEYAVKV  50
    ||||||||||||||||||||||||||||||||||||||||||||||||||
  1 MTRDEALPDSHSAQDFYENYEPKEILGRGVSSVVRRCIHKPTSQEYAVKV  50

51 IDVTGGGSFSPEEVRELREATLKEVDILRKVSGHPNISIQLKDTYETNTF 100
    |||||||||||||||||||||||||||||||||||||| |||||||||||
 51 IDVTGGGSFSPEEVRELREATLKEVDILRKVSGHPNI.IQLKDTYETNTF  99

101 FFLVFDLMKRGELFD 115
    |||||||||||||||
100 FFLVFDLMKRGELFD 114
```

FIG. 6

```
  1 VFLGRCRSVKEFEKLNRIGEGTYGIVYRARDTQTDEIVALKKVRMDKEKD  50
    ||||||||||||||||||||||||||||||||||||||||||||||||||
  1 VFLGRCRSVKEFEKLNRIGEGTYGIVYRARDTQTDEIVALKKVRMDKEKD  50

51 GIPISSLREITLLLRLRHPNIVELKEVVVGNHLESIFLVMGYCEQDLASL 100
    ||||||||||||||||||||||||||||||||||||||||||||||||||
 51 GIPISSLREITLLLRLRHPNIVELKEVVVGNHLESIFLVMGYCEQDLASL 100

101 LENMPTPFSEAQVKCIVLQVLRGLQYLHRNFIIHRDLKVSNLLMTDKGCV 150
    ||||||||||||||||||||||||||||||||||||||||||||||||||
101 LENMPTPFSEAQVKCIVLQVLRGLQYLHRNFIIHRDLKVSNLLMTDKGCV 150

151 KTGGCNLGQAWSL 163
    ||: :|::|:::
151 KTADFGLARAYGV 163
```

FIG. 7

```
 22 AVGCILAELLAHRPLLPGTSEIHQIDLIVQLLGTPSENIWPGFSKLPLVG  71
    ||||||||||||||||||||||||||||||||||||||||||||||||||
197 AVGCILAELLAHRPLLPGTSEIHQIDLIVQLLGTPSENIWPGFSKLPLVG 246

72 QYSLRKQPYNNLKHKFPWLSEAGLRLLHFLFMYDPKKRATAGDCLESSYF 121
    ||||||||||||||||||||||||||||||||||||||||||||||||||
247 QYSLRKQPYNNLKHKFPWLSEAGLRLLHFLFMYDPKKRATAGDCLESSYF 296

122 KEKPLRLPISGVCEGCREPG 141
    ||||||||||||||||||||
297 KEKPLRLPISGVCEGCREPG 316
```

FIG. 8

```
 1  VFLGRCRSVKEFEKLNRIGEGTYGIVYRARDTQTDEIVALKKVRMDKEKD  50
    ||||||||||||||||||||||||||||||||||||||||||||||||||
 1  VFLGRCRSVKEFEKLNRIGEGTYGIVYRARDTQTDEIVALKKVRMDKEKD  50

51  GIPISSLREITLLLRLRHPNIL  72
    ||||||||||||||||||||:
51  GIPISSLREITLLLRLRHPNIV  72
```

FIG. 9

```
  1 MGEAEKFHYIYSCDLDINVQLKIGSLEGKREQKSYKAVLEDPMLKFSGLY  50
    ||||||||||||||||||||||||||||||||||:|||||||||||||||
  1 MGEAEKFHYIYSCDLDINVQLKIGSLEGKREQKSYNAVLEDPMLKFSGLY  50

51 QETCSDLYVTCQVFAEGKPLALPVRTSYKAFSTRWNWNEWLKLPVKYPDL 100
    |||||||||||||||||| |||||||||||||||||||||||||||||||
 51 QETCSDLYVTCQVFAEGKPSALPVRTSYKAFSTRWNWNEWLKLPVKYPDL 100

101 PRNAQVALTIWDVYGPGKAVPVGGTTVSLFGKYGMFRQGMHDLKVWPNVE 150
    |||||||||||||||||||||||||||||||||| |||||||||||||||
101 PRNAQVALTIWDVYGPGKAVPVGGTTVSLFGKYGMSRQGMHDLKVWPNVE 150

151 ADGSEPTKTPGRTSSTLSEDQMSRLAKLTKAHRQGHMVKKVDWLDRLTFRE 200
    ||||||| :|||||||||||||||||||||||||||||||||||||||||
151 ADGSEPTNTPGRTSSTLSEDQMSRLAKLTKAHRQGHMVKKVDWLDRLTFRE 200

201 IEMINESVKRSSNFMYLMGGFRCVKCDDKEYGIVYYEKDGDESSPILTSF 250
    |||||||||||||||||||||||||||||||||||||||||||||||||
201 IEMINESVKRSSNFMYLMGGFRCVKCDDKEYGIVYYEKDGDESSPILTSF 250

251 ELVKVPDPQMSLENLVESKHHNLPRSLRSGPSDHDLKPYPSPRDQLKNIV 300
    |||||||||||||||||||||||||||||||||||||||||||||||||
251 ELVKVPDPQMSLENLVESKHHNLPRSLRSGPSDHDLKPYPSPRDQLKNIV 300
```

FIG. 10

```
301 SYPPSKPPTYEEQDLVWEFRYYLTNQDKALTKILTSVIWDLPQEAKQALA 350
    ||||||||||||||||||||||||||||||||||||||||||||||||||
301 SYPPSKPPTYEEQDLVWEFRYYLTNQDKALTKILTSVIWDLPQGAKQALA 350

351 LLGKWNPMDVEDSLELISSHYTNPTVRRYAVARLRQADDEDLLMYLLQLV 400
    ||||||||||||||||||||||||||||||||||||||||||||| |||
351 LLGKWNPMDVEDSLELISSHYTNPTVRRYAVARLRQADDEDLLMYLSQLV 400

401 QALKYENFDDIKNGLEPTKKDSQSSVSENVSNSGINSAEIDSSQIITSPL 450
    |||||||||||||||||||||||||||| ||||||||||||||||||||
401 QALKYENFDDIKNGLEPTKKDSQSSVSGNVSNSGINSAEIDSSQIITSPL 450

451 PSVSSPPPASKTKEVPDGENLEQDLCTFLISRACKNSTLANYLYWYVIVE 500
    ||||||||||||||||||||||||||||||| |||||||||||||||||
451 PSVSSPPPASKTKEVPDGENLEQDLCTFLISRASKNSTLANYLYWYVIVE 500

501 CEDQDTQQRDPKTHEMYLNVMRRFSQALLKGDKSVRVMRSLLAAQQTFVD 550
    ||||||||||||||||||||||||||||||||||||||||||||||||||
501 CEDQDTQQRDPKTHEMYLNVMRRFSQALLKGDKSVRVMRSLLAAQQTFVD 550
```

FIG. 10 (CONT.¹)

```
551 RLVHLMKAVQRESGNRKKKNERLQALLGDNEKMNLSDVELIPLPLEPQVK 600
    |||||||||||||||||||||||||||||||||||||||||||||||||
551 RLVHLMKAVQRESGNRKKKNERLQALLGDNEKMNLSDVELIPLPLEPQVK 600

601 IRGIIPETATLFKSALMPAQLFFKTEDGGKYPVIFKHGDDLRQDQLILQI 650
    |||||||||||||||||||||||||||||||||||||||||||||||||
601 IRGIIPETATLFKSALMPAQLFFKTEDGGKYPVIFKHGDDLRQDQLILQI 650

651 ISLMDKLLRKENLDLKLTPYKVLATSTKHGFMQFIQSVPVAEVLDTEGSI 700
    |||||||||||||||||||||||||||||||||||||||||||||||||
651 ISLMDKLLRKENLDLKLTPYKVLATSTKHGFMQFIQSVPVAEVLDTEGSI 700

701 QNFFRKYAPSENGPNGISAEVMDTYVKSCAGYCVITYILGVGDRHLDNLL 750
    ||||||||||||||||||||||||||||||||||||||||||||||||:
701 QNFFRKYAPSENGPNGISAEVMDTYVKSCAGYCVITYILGVGDRHLDNLV 750

751 LTKTG 755
    |||||
751 LTKTG 755
```

FIG. 10 (CONT.²)

```
  1 MGEAEKFHYIYSCDLDINVQLKIGSLEGKREQKSYKAVLEDPMLKFSGLY   50
    ||||||||||||||||||||||||||||||||||:|||||||||||||||
  1 MGEAEKFHYIYSCDLDINVQLKIGSLEGKREQKSYNAVLEDPMLKFSGLY   50

51 QETCSDLYVTCQVFAEGKPLALPVRTSYKAFSTRWNWNEWLKLPVKYPDL  100
    |||||||||||||||||| |||||||||||||||||||||||||||||||
 51 QETCSDLYVTCQVFAEGKPSALPVRTSYKAFSTRWNWNEWLKLPVKYPDL  100

101 PRNAQVALTIWDVYGPGKAVPVGGTTVSLFGKYGMFRQGMHDLKVWPNVE  150
    ||||||||||||||||||||||||||||||||||| |||||||||||||
101 PRNAQVALTIWDVYGPGKAVPVGGTTVSLFGKYGMSRQGMHDLKVWPNVE  150

151 ADGSEPTKTPGRTSSTLSEDQMSRLAKLTKAHRQGHMVKVDWLDRLTFRE  200
    ||||||| |||||||||||||||||||||||||||||||||||||||||
151 ADGSEPTNTPGRTSSTLSEDQMSRLAKLTKAHRQGHMVKVDWLDRLTFRE  200

201 IEMINESVKRSSNFMYLMGGFRCVKCDDKEYGIVYYEKDGDESSPILTSF  250
    |||||||||||||||||||||||||||||||||||||||||||||||||
201 IEMINESVKRSSNFMYLMGGFRCVKCDDKEYGIVYYEKDGDESSPILTSF  250

251 ELVKVPDPQMSLENLVESKHHNLPRSLRSGPSDHDLKPYPSPRDQLKNIV  300
    |||||||||||||||||||||||||||||||||||||||||||||||||
251 ELVKVPDPQMSLENLVESKHHNLPRSLRSGPSDHDLKPYPSPRDQLKNIV  300
```

FIG. 11

```
301 SYPPSKPPTYEEQDLVWEFRYYLTNQDKALTKILTSVIWDLPQEAKQALA 350
    ||||||||||||||||||||||||||||||||||||||||||| ||||
301 SYPPSKPPTYEEQDLVWEFRYYLTNQDKALTKILTSVIWDLPQGAKQALA 350

351 LLGKWNPMDVEDSLELISSHYTNPTVRRYAVARLRQADDEDLLMYLLQLV 400
    ||||||||||||||||||||||||||||||||||||||||||||| |||
351 LLGKWNPMDVEDSLELISSHYTNPTVRRYAVARLRQADDEDLLMYLSQLV 400

401 QALKYENFDDIKNGLEPTKKDSQSSVSENVSNSGINSAEIDSSQIITSPL 450
    ||||||||||||||||||||||||||||| |||||||||||||||||||
401 QALKYENFDDIKNGLEPTKKDSQSSVSGNVSNSGINSAEIDSSQIITSPL 450

451 PSVSSPPPASKTKEVPDGENLEQDLCTFLISRACKNSTLANYLYWYVKII 500
    |||||||||||||||||||||||||||||||| |||||||||||||  :
451 PSVSSPPPASKTKEVPDGENLEQDLCTFLISRASKNSTLANYLYWYV.IV 499

```
  1 MGNAAAAKKGSEQESVKEFLAKAKEDFLKKWESPAQNTAHLDQFERIKTL 50
    |||||||||||||||||||||||||||||||||||||||||||||||||||
  1 MGNAAAAKKGSEQESVKEFLAKAKEDFLKKWESPAQNTAHLDQFERIKTL 50

51 GTGSFGRVMLVKHKETGNHYAMKILDKQKVVKLKQIEHTLNEKRILQAVN 100
    |||||||||||||||||||||||||||||||||||||||||||||||||||
 51 GTGSFGRVMLVKHKETGNHYAMKILDKQKVVKLKQIEHTLNEKRILQAVN 100

101 FPFLVKLEFSFKDNSNLYMVMEYVPGGEMFSHLRRRIGRF 139
    |||||||||||||||||||||||||||||||||||||||
101 FPFLVKLEFSFKDNSNLYMVMEYVPGGEMFSHLRRRIGRF 139
```

FIG. 12

```
  1 MVVFNGLLKIKICEAVSLKPTAWSLRHAVGPRPQTFLLDPYIALNVDDSR  50
    |||||||||||||||||||||||||||||||||||||||||||||||||
  1 MVVFNGLLKIKICEAVSLKPTAWSLRHAVGPRPQTFLLDPYIALNVDDSR  50

51 IGQTATKQKTNSPAWHDEFVTDVCNGRKIELAVFEHDAPIGYDDFVANCTI 100
    ||||||||||||||||||||||||||||||||||||||||||||||||||
 51 IGQTATKQKTNSPAWHDEFVTDVCNGRKIELAVFEHDAPIGYDDFVANCTI 100

101 QFEELLQNGSRHFEDWIDLEPEGRVYVIIDLSGSSGEVKIPNSAFCERER 150
    |||||||||||||||||||||||||||||||||||  |:  |     |||
101 QFEELLQNGSRHFEDWIDLEPEGRVYVIIDLSGSSGEAPKDNEERVFRER 150

151 VEMR 154
    :: |
151 MRPR 154
```

FIG. 13

```
  1 MILIPRMLLVLFLLLPILSSAKAQVNPAICRYPLGMSGGQIPDEDITASS  50
    ||||||||||||||||||||||||||||||||||||||||||||||||||
  1 MILIPRMLLVLFLLLPILSSAKAQVNPAICRYPLGMSGGQIPDEDITASS  50

51 QWSESTAAKYGRLDSEEGDGAWCPEIPVEPDDLKEFLQIDLHTLHFITLV 100
    ||||||||||||||||||||||||||||||||||||||||||||||||||
 51 QWSESTAAKYGRLDSEEGDGAWCPEIPVEPDDLKEFLQIDLHTLHFITLV 100

101 GTQGRHAGGHGIEFAPMYKINYSRDGTRWISWRNRHGKQVLDGNSNPYDI 150
    ||||||||||||||||||||||||||||||||||||||||||||||||||
101 GTQGRHAGGHGIEFAPMYKINYSRDGTRWISWRNRHGKQVLDGNSNPYDI 150

151 FLKDLEPPIVARFVRFIPVTDHSMNVCMRVELYGCVWLDGLVSYNAPAGQ 200
    ||||||||||||||||||||||||||||||||||||||||||||||||||
151 FLKDLEPPIVARFVRFIPVTDHSMNVCMRVELYGCVWLDGLVSYNAPAGQ 200

201 QFVLPGGSIIYLNDSVYDGAVGYSMTEGLGQLTDGVSGLDDFTQTHEYHV 250
    ||||||||||||||||||||||||||||||||||||||||||||||||||
201 QFVLPGGSIIYLNDSVYDGAVGYSMTEGLGQLTDGVSGLDDFTQTHEYHV 250

251 WPGYDYVGWRNESATNGYIEIMFEFDRIRNFTTMKVHCNNMFAKGVKIFK 300
    ||||||||||||||||||||||||||||||||||||||||||||||||||
251 WPGYDYVGWRNESATNGYIEIMFEFDRIRNFTTMKVHCNNMFAKGVKIFK 300
```

FIG. 14

```
301 EVQCYFRSEASEWEPNAISFPLVLDDVNPSARFVTVPLHHRMASAIKCQY 350
    ||||||||||||||||||||||||||||||||||||||||||||||||||
301 EVQCYFRSEASEWEPNAISFPLVLDDVNPSARFVTVPLHHRMASAIKCQY 350

351 HFADTWMMFSEITFQSDAAMYNNSEALPTSPMAPTTYDPMLKVDDSNTRI 400
    ||||||||||||||||||||||||||||||||||||||||||||||||||
351 HFADTWMMFSEITFQSDAAMYNNSEALPTSPMAPTTYDPMLKVDDSNTRI 400

401 LIGCLVAIIFILLAIIVIILWRQFWQKMLEKASRRMLDDEMTVSLSLPSD 450
    ||||||||||||||||||||||||||||||||||||||||||||||||||
401 LIGCLVAIIFILLAIIVIILWRQFWQKMLEKASRRMLDDEMTVSLSLPSD 450

451 SSMFNNRSSSPSEQGSNSTYDRIFPLRPDYQEPSRLIRKLPEFAPGEEE 500
    |||||||||||||||||||||||||||||||||||||||||||||||||
451 SSMFNNRSSSPSEQGSNSTYDRIFPLRPDYQEPSRLIRKLPEFAPGEEE 500

501 SG..............EDDVVE.QGVKGETSASI 519
    ||              | :|: ||| |  | :: |:
501 SGCSGVVKPVQPSGPEGVPHYAEADIVNLQGVTGGNTYSV 540
```

FIG. 14 (CONT.¹)

```
  1 MANFQEHLSCSSSPHLPFSESKTFNGLQDELTAMGNHPSPKLLEDQQEKG   50
    ||||||||||||||||||||||||||||||||||||||||||||||||||
  1 MANFQEHLSCSSSPHLPFSESKTFNGLQDELTAMGNHPSPKLLEDQQEKG   50

51 MVRTELIESVHSPVTTVLTSVSEDSRDQFENSVLQLREHDESETAVSQG  100
    ||||||||||||||||||||||||||||||||||||||||||||||||||
 51 MVRTELIESVHSPVTTVLTSVSEDSRDQFENSVLQLREHDESETAVSQG  100

101 NSNTVDGESTSGTEDIKIQFSRSGSGSGGFLEGLFGCLRPVWNIIGKAYS  150
    ||||||||||||||||||||||||||||||||||||||||||||||||||
101 NSNTVDGESTSGTEDIKIQFSRSGSGSGGFLEGLFGCLRPVWNIIGKAYS  150

151 TDYKFMQQDTWEVPFEEISELQWLGSGAQGAVFLGKFRAEEVAIKKVREQ  200
    ||||| ::||||||||||||||||||||||||||||||||||||||||||
151 TDYKLQQQDTWEVPFEEISELQWLGSGAQGAVFLGKFRAEEVAIKKVREQ  200

201 NETDIKHLRKLKHPNIIAFKGVCTQAPCYCIIMEYCAHGQLYEVLRAGRK  250
    ||||||||||||||||||||||||||||||||||||||||||||||||||
201 NETDIKHLRKLKHPNIIAFKGVCTQAPCYCIIMEYCAHGQLYEVLRAGRK  250

251 ITPRLLVDWSTGIASGMNYLHLHKIIHRDLKSP  283
    ||||||||||||||||||||||||||||||||
251 ITPRLLVDWSTGIASGMNYLHLHKIIHRDLKSP  283
```

FIG. 15

```
 21 KSGNKSVHLRKASSPNLHRRQWEKNVPNTALTALENASILTSSLTAEDDR  70
    ::  |||||||||||||||||||||||||||||||||||||||||||||||
295 EKGNKSVHLRKASSPNLHRRQWEKNVPNTALTALENASILTSSLTAEDDR 344

71 GGSVIKYSKNTTRKQWLKETPDTLLNILKNADLSLAFQTYTIYRPGSEGF 120
    |||||||||||||||||||||||||||||||||||||||||||||||||
345 GGSVIKYSKNTTRKQWLKETPDTLLNILKNADLSLAFQTYTIYRPGSEGF 394

121 LKGPLSEETEASDSVDGGHDSVILDPERLEPGLDEEDTDFEEEDNPDWV 170
    ||||||||||||||||||||||||||||||||||||||||||||||||
395 LKGPLSEETEASDSVDGGHDSVILDPERLEPGLDEEDTDFEEEDNPDWV 444

171 SELKKRAGWQGLCDR 185
    |||||||||||||||
445 SELKKRAGWQGLCDR 459
```

FIG. 16

```
1 MAPPSEETPLIPQRSCSLLSTEAGALHVLLPARGPGPPQRLSFSFG  46
  ||||||||||||||||||||||||||||||||||| :||||||||||
1 MAPPSEETPLIPQRSCSLLSTEAGALHVLLPARAPGPPQRLSFSFG  46
```

FIG. 17

```
  1 MAESAGASSFFPLVVLLLAGSGGSGPRGVQALLCACTSCLQANYTCETDG  50
    ||||||||||||||||||||||||||||||||||||||||||||||||||
  1 MAESAGASSFFPLVVLLLAGSGGSGPRGVQALLCACTSCLQANYTCETDG  50

51 ACMVSIFNLDGMEHHVRTCIPKVELVPAGKPFYCLSSEDLRNTHCCYTDY 100
    ||||||||||||||||||||||||||||||||||||||||||||||||||
 51 ACMVSIFNLDGMEHHVRTCIPKVELVPAGKPFYCLSSEDLRNTHCCYTDY 100

101 CNRIDLRVPSGHLKEPEHPSMWGPVELVGIIAGPVELLFLIIIVFLVIN  150
    ||||||||||||||||||||||||||||||||||||||||||||||||
101 CNRIDLRVPSGHLKEPEHPSMWGPVELVGIIAGPVELLFLIIIVFLVIN  150

151 YHQRVYHNRQRLDMEDPSCEMCLSKDKTLQDLVYDLSTSGSGSGTKFF  198
    ||||||||||||||||||||||||||||||||||||||||||  :|
151 YHQRVYHNRQRLDMEDPSCEMCLSKDKTLQDLVYDLSTSGSGSGLPLF  198
```

FIG. 18

```
  1 MDEQEALNSIMNDLVALQMNRRHRMPGYETMKNKDTGHSNRQSDVRIKFE  50
    ||||||||||||||||||||||||||||||||||||||||||||||||||
  1 MDEQEALNSIMNDLVALQMNRRHRMPGYETMKNKDTGHSNRQSDVRIKFE  50

51 HNGERRIIAFSRPVKYEDVEHKVTTVFGQPLDLHYMNNELSILLKNQDDL 100
    ||||||||||||||||||||||||||||||||||||||||||||||||||
 51 HNGERRIIAFSRPVKYEDVEHKVTTVFGQPLDLHYMNNELSILLKNQDDL 100

101 DKAIDILDRSSSMKSLRILLLSQDRNHNSSSPHSEVSRQVRIKASQSAGD 150
    ||||||||||||||||||||||||||||||||||||||||||||||||||
101 DKAIDILDRSSSMKSLRILLLSQDRNHNSSSPHSEVSRQVRIKASQSAGD 150

151 INTIYQPPEPRSRHLSVSSQNPGRSSPPPGYVPERQQHIARQGSYTSINS 200
    ||||||||||||||||||||||||||||||||||||||||||||||||||
151 INTIYQPPEPRSRHLSVSSQNPGRSSPPPGYVPERQQHIARQGSYTSINS 200

201 EGEFIPETSEQCMLDPLSSAENSLSGSCQSLDRSADSPSFRKSRMSRAQS 250
    ||||||||||||||||||||||||||||||||||||||||||||||||||
201 EGEFIPETSEQCMLDPLSSAENSLSGSCQSLDRSADSPSFRKSRMSRAQS 250
```

FIG. 19

```
251 FPDNRQEYSDRETQLYDKGVKGGTYPRRYHVSVHHKDYSDGRRTFPRIRR 300
    |||||||||||||||||||||||||||||||||||||||||||||||||
251 FPDNRQEYSDRETQLYDKGVKGGTYPRRYHVSVHHKDYSDGRRTFPRIRR 300

301 HQGNLFTLVPSSRSLSTNGENMGLAVQYLDPRGRLRSADSENALSVQERN 350
    |||||||||||||||||||||||||||||||||||||||||||||||||
301 HQGNLFTLVPSSRSLSTNGENMGLAVQYLDPRGRLRSADSENALSVQERN 350

351 VPTKCEELSLARRRLPRWSQTSYGGKQLG 379
    |||  :  ||           ||   ||
351 VPTKSPSAPINWRR............GKLLG 369
```

FIG. 19 (CONT.¹)

```
  1 MDEQEALNSIMNDLVALQMNRRHRMPGYETMKNKDTGHSNRQKKHNSSSS  50
    ||||||||||||||||||||||||||||||||||||||||
  1 MDEQEALNSIMNDLVALQMNRRHRMPGYETMKNKDTGHSNRQ.........  42

51 ALLNSPTVTTSSCAGASEKKKFLSDVRIKFEHNGERRIIAFSRPVKYEDV 100
                             ||||||||||||||||||||||||
 43 .....................SDVRIKFEHNGERRIIAFSRPVKYEDV  69

101 EHKVTTVFGQPLDLHYMNNELSILLKNQDDLDKAIDILDRSSSMKSLRIL 150
    |||||||||||||||||||||||||||||||||||||||||||||||||
 70 EHKVTTVFGQPLDLHYMNNELSILLKNQDDLDKAIDILDRSSSMKSLRIL 119

151 LLSQDRNHNSSSPHSEVSRQVRIKASQSAGDINTIYQPPEPRSRHLSVSS 200
    |||||||||||||||||||||||||||||||||||||||||||||||||
120 LLSQDRNHNSSSPHSEVSRQVRIKASQSAGDINTIYQPPEPRSRHLSVSS 169

201 QNPGRSSPPPGYVPERQQHIARQGSYTSINSEGEFIPETSEQCMLDPLSS 250
    |||||||||||||||||||||||||||||||||||||||||||||||||
170 QNPGRSSPPPGYVPERQQHIARQGSYTSINSEGEFIPETSEQCMLDPLSS 219
```

FIG. 20

```
251 AENSLSGSCQSLDRSADSPSFRKSRMSRAQSFPDNRQEYSDRETQLYDKG 300
    |||||||||||||||||||||||||||||||||||||||||||||||||
220 AENSLSGSCQSLDRSADSPSFRKSRMSRAQSFPDNRQEYSDRETQLYDKG 269

301 VKGGTYPRRYHVSVHHKDYSDGRRTFPRIRRHQGNLFTLVPSSRSLSTNG 350
    |||||||||||||||||||||||||||||||||||||||||||||||||
270 VKGGTYPRRYHVSVHHKDYSDGRRTFPRIRRHQGNLFTLVPSSRSLSTNG 319

351 ENMGLAVQYLDPRGRLRSADSENALSVQERNVPTKCEELSLARRRLPRWS 400
    ||||||||||||||||||||||||||||||||||||| : :    ||
320 ENMGLAVQYLDPRGRLRSADSENALSVQERNVPTKSPSAPINWRR..... 364

401 QTSYGGKQLG 410
    ||   ||
365 .....GKLLG 369
```

FIG. 20 (CONT.¹)

```
  1 MAKQYDSVECPFCDEVSKYEKLAKIGQGTFGEVFKARHRKTGQKVALKKV  50
    |||||||||||||||||||||||||||||||||||||||||||||||||
  1 MAKQYDSVECPFCDEVSKYEKLAKIGQGTFGEVFKARHRKTGQKVALKKV  50

51 LMENEKEGFPITALREIKILQLLKHENVVNLIEICRTKASPYNRCKGSIY 100
    |||||||||||||||||||||||||||||||||||||||||||||||||
 51 LMENEKEGFPITALREIKILQLLKHENVVNLIEICRTKASPYNRCKGSIY 100

101 LVFDFCEHDLAGLLSNVLVKFTLSEIKRVMQMLLNGLYY........... 139
    ||||||||||||||||||||||||||||||||||||||
101 LVFDFCEHDLAGLLSNVLVKFTLSEIKRVMQMLLNGLYYIHRNKILHRDM 150

139 .................................................139

151 KAANVLITRDGVLKLADFGLARAFSLAKNSQPNRYTNRVVTLWYRPPELL 200

139 .................................................139

201 LGERDYGPPIDLWGAGCIMAEMWTRSPIMQGNTEQHQLALISQLCGSITP 250
```

FIG. 21

```
139 ......................................................... 139
251 EVWPNVDNYELYEKLELVKGQKRKVKDRLKAYVRDPYALDLIDKLLVLDP 300
140 ..........NHDFFWSDPMPSDLKGMLSTHLTSMFEYLAPPRRKGSQIT 179
            ||||||||||||||||||||||||||||||||||||||
301 AQRIDSDDALNHDFFWSDPMPSDLKGMLSTHLTSMFEYLAPPRRKGSQIT 350

180 QQSTNQSRNPATTNQTEFEERVF 201
    ||||||||||||||||||||||
351 QQSTNQSRNPATTNQTEFEERVF 372
```

FIG. 21 (CONT.¹)

```
  1 MATSRYEPVAEIGVGAYGTVYKARDPHSGHFCALKSVRVPNGGGGGGLP  50
    ||||||||||||||||||||||||||||||| |||||||||||||||||
  1 MATSRYEPVAEIGVGAYGTVYKARDPHSGHFVALKSVRVPNGGGGGGLP  50

51 ISTVREVALLRRRLEAFEHPNVVRLMDVCATSRTDREIKVTLVFEHVDQDL 100
    ||||||||||||||||||||||||||||||||||||||||||||||||||
 51 ISTVREVALLRRRLEAFEHPNVVRLMDVCATSRTDREIKVTLVFEHVDQDL 100

101 RTYLDKAPPPGLPAETIK 118
    ||||||||||||||||||
101 RTYLDKAPPPGLPAETIK 118
```

FIG. 22

```
1 MATSRYEPVAEIGVGAYGTVYKARDPHSGHFCALKSVRVP 40
  ||||||||||||||||||||||||||||||| |||||||
1 MATSRYEPVAEIGVGAYGTVYKARDPHSGHFVALKSVRVP 40
```

FIG. 23

```
 34  PLPLEPRAVYCKDVLDIEQFSTVKGVNLDHTDDDFYSKFSTGSVSIPWQN   83
     |: :||||||||||||||||||||||||||||||||||||||||||||||
464  PFVPDPRAVYCKDVLDIEQFSTVKGVNLDHTDDDFYSKFSTGSVSIPWQN  513

84  EMIETECFKELNVFGPNGTLPPDLNRNHPPEPPKKGLLQRLFKRQHQNNS  133
     ||||||||||||||||||||||||||||||||||||||||||||||||||
514  EMIETECFKELNVFGPNGTLPPDLNRNHPPEPPKKGLLQRLFKRQHQNNS  563

134  KSSPSSKTSFNHHINSNHVSSNSTGSS  160
     |||||||||||||||||||||||||||
564  KSSPSSKTSFNHHINSNHVSSNSTGSS  590
```

FIG. 24

```
 28 LLSPSGHIRISDLGLAVKIPEGDLIRGRVGTVGYMAPEVLNNQRYGLSPD  77
    ||:  |||||||||||||||||||||||||||||||||||||||||||||
318 LLDDYGHIRISDLGLAVKIPEGDLIRGRVGTVGYMAPEVLNNQRYGLSPD 367

78 YWGLGCLIYEMIEGQSPFRGRKEKVKREEVDRRVLETEEVYSHKFSEEAK 127
    |||||||||||||||||||||||||||||||||||||||||||||||||
368 YWGLGCLIYEMIEGQSPFRGRKEKVKREEVDRRVLETEEVYSHKFSEEAK 417

128 SICKMLLTKDAKQRLGCQEEGAAEVKRHPFFRNMFKRLEAGMLDPPFVP  177
    |||||||||||||||||||||||||||||||||||||||||||||||||
418 SICKMLLTKDAKQRLGCQEEGAAEVKRHPFFRNMFKRLEAGMLDPPFVP  467

178 DPRAVYCKDVLDIEQFSTVKGVNLDHTDDDFYSKFSTGSVSIPWQNEMIE 227
    |||||||||||||||||||||||||||||||||||||||||||||||||
468 DPRAVYCKDVLDIEQFSTVKGVNLDHTDDDFYSKFSTGSVSIPWQNEMIE 517

228 TECFKELNVFGPNGTLPPDLNRNHPPEPPKKGLLQRLFKRQHQNNSKSSP 277
    |||||||||||||||||||||||||||||||||||||||||||||||||
518 TECFKELNVFGPNGTLPPDLNRNHPPEPPKKGLLQRLFKRQHQNNSKSSP 567

278 SSKTSFNHHINSNHVSSNSTGSS 300
    |||||||||||||||||||||||
568 SSKTSFNHHINSNHVSSNSTGSS 590
```

FIG. 25

```
 30 LLSPSGHIRISDLGLAVKIPEGDLIRGRVGTVGYMAPEVLNNQRYGLSPD  79
    ||:   ||||||||||||||||||||||||||||||||||||||||||||
318 LLDDYGHIRISDLGLAVKIPEGDLIRGRVGTVGYMAPEVLNNQRYGLSPD 367

80 YWGLGCLIYEMIEGQSPFRGRKEKVKREEVDRRVLETEEVYSHKFSEEAK 129
    |||||||||||||||||||||||||||||||||||||||||||||||||
368 YWGLGCLIYEMIEGQSPFRGRKEKVKREEVDRRVLETEEVYSHKFSEEAK 417

130 SICKMVSSWWPDATLKLVAPSLGLAPV 156
    |||||:   ||    :|  :|  |  |
418 SICKMLLT..KDAKQRLGCQEEGAAEV 442
```

FIG. 26

```
  1 MAPFLRIAFNSYELGSLQAEDEANQPFCAVKMKEALSTERGKTLVQKKPT  50
    ||||||||||||||||||||||||||||||||||||||||||||||||||
  1 MAPFLRIAFNSYELGSLQAEDEANQPFCAVKMKEALSTERGKTLVQKKPT  50

51 MYPEWKSTFDAHIYEGRVIQIVLMRAAEEPVSEVTVGVSVLAERCKKNNG 100
    ||||||||||||||||||||||||||||||||||||||||||||||||||
 51 MYPEWKSTFDAHIYEGRVIQIVLMRAAEEPVSEVTVGVSVLAERCKKNNG 100

101 KAEFWLDLQPQAKVLMSVQYFLEDVDCKQSMRSEDEAKFPTMNRRGAIKQ 150
    ||||||||||||||||||||||||||||||||||||||||||||||||||
101 KAEFWLDLQPQAKVLMSVQYFLEDVDCKQSMRSEDEAKFPTMNRRGAIKQ 150

151 AKIHYIKNHEFIATFFGQPTFCSVCKDFWGLNKQGYKCRQCNAAIHKKC 200
    ||||||||||||||||||||||||||||||||||||||||||||||||||
151 AKIHYIKNHEFIATFFGQPTFCSVCKDFWGLNKQGYKCRQCNAAIHKKC 200

201 IDKIIGRCTGTAANSRDTIFQKERFNIDMPHRFKVHNYMSPTFCDHCGSL 250
    ||||||||||||||||||||||||||||||||||||||||||||||||||
201 IDKIIGRCTGTAANSRDTIFQKERFNIDMPHRFKVHNYMSPTFCDHCGSL 250

251 LLPAPHDKHQW............DCG 264
    |          |            |||
251 L..........WGLVKQGLKCEDCG 265
```

FIG. 27

```
  1 MDETHPGYGKEVDLEFLVSPSLPCLLSFAGSARHLVPPDSNLFSKLWACG   50
    ||||||||||||||                              |||||
203 MDETHPGYGKEVD.........................LWACG       220

51 VILFTLLAGSPPEWHRRQILMLRMIMEGQYQFSSPEWDDRSSTVKDLISR  100
    |||||||||||||||||||||||||||||||||||||||||||||||||
221 VILFTLLAGSPPEWHRRQILMLRMIMEGQYQFSSPEWDDRSSTVKDLISR  270

101 LLQVDPEARLTAEQALQHPFFERCEGSQPWNLTPRQRFRVAVWTVLAAGR  150
    |||||||||||||||||||||||||||||||||||||||||||||||||
271 LLQVDPEARLTAEQALQHPFFERCEGSQPWNLTPRQRFRVAVWTVLAAGR  320

151 VALSTHRVRPLTKNALLRDPYALRSVRHLIDNCAFRLYGHWVKKGEQQNR  200
    |||||||||||||||||||||||||||||||||||||||||||||||||
321 VALSTHRVRPLTKNALLRDPYALRSVRHLIDNCAFRLYGHWVKKGEQQNR  370

201 AALFQHRPPGPFPIMGPEEEGDSAAITEDEAVLVLG  236
    |||||||||||||||||||||||||||||||||||
371 AALFQHRPPGPFPIMGPEEEGDSAAITEDEAVLVLG  406
```

FIG. 28

```
  1  MAFCAKMRSSKKTEVNLEAPEPGVEVIFYLSDREPLRLGSGEYTAEELCI      50
     ||||||||||||||||||||||||||||||||||||||||||||||||||
  1  MAFCAKMRSSKKTEVNLEAPEPGVEVIFYLSDREPLRLGSGEYTAEELCI      50

51  RAAQACRISPLCHNLFALYDENTKLWYAPNRTITVDDKMSLRLHYRMRFY     100
     ||||||||||||||||||||||||||||||||||||||||||||||||||
 51  RAAQACRISPLCHNLFALYDENTKLWYAPNRTITVDDKMSLRLHYRMRFY     100

101  FTNWHGTNDNEQSVWRHSPKKQKNGYEKKKIPDATPLLDASSLEYLFAQG     150
     ||||||||||||||||||||||||||||||||||||||||||||||||||
101  FTNWHGTNDNEQSVWRHSPKKQKNGYEKKKIPDATPLLDASSLEYLFAQG     150

151  QYDLVKCLAPIRDPKTEQDGHDIENECLGMAVLAISHYAMMKKMQLPELP     200
     ||||||||||||||||||||||||||||||||||||||||||||||||||
151  QYDLVKCLAPIRDPKTEQDGHDIENECLGMAVLAISHYAMMKKMQLPELP     200

201  KDISYKRYIPETLNKSIRQRNLLTRMRINNVFKDFLKEFNNKTICDSSVS     250
     ||||||||||||||||||||||||||||||||||||||||||||||||||
201  KDISYKRYIPETLNKSIRQRNLLTRMRINNVFKDFLKEFNNKTICDSSVS     250

251  THDLKVKYLATLETLTKHYGAEIFETSMLLISSENEMNWFHSNDGGNVLY     300
     ||||||||||||||||||||||||||||||||||||||||||||||||||
251  THDLKVKYLATLETLTKHYGAEIFETSMLLISSENEMNWFHSNDGGNVLY     300
```

FIG. 29

```
301 YEVMVTGNLGIQWRHKPNVVSVEKEKNKLKRKKLENKDKKDEEKNKIREE 350
    |||||||||||||||||||||||||||||||||||||||||||||||||
301 YEVMVTGNLGIQWRHKPNVVSVEKEKNKLKRKKLENKDKKDEEKNKIREE 350

351 WNNFSFFPEITHIVIKESVVSINKQDNKKMELKLSSHEEALSFVSLVDGY 400
    |||||||||||||||||||||||||||||||||||||||||||||||||
351 WNNFSFFPEITHIVIKESVVSINKQDNKKMELKLSSHEEALSFVSLVDGY 400

401 FRLTADAHHYLCTDVAPPLIVHNIQNGCHGPICTEYAINKLRQEGSEEGM 450
    |||||||||||||||||||||||||||||||||||||||||||||||||
401 FRLTADAHHYLCTDVAPPLIVHNIQNGCHGPICTEYAINKLRQEGSEEGM 450

451 YVLRWSCTDFDNILMTVTCFEKSEQVQGAQKQFKNFQIEVQKGRYSLHGS 500
    |||||||||||||||||||||||||||||||||||||||||||||||||
451 YVLRWSCTDFDNILMTVTCFEKSEQVQGAQKQFKNFQIEVQKGRYSLHGS 500

501 DRSFPSLGDLMSHLKKQILRTDNISFMLKRCCQPKPR 537
    ||||||||||||||||||||||||||||||||||||
501 DRSFPSLGDLMSHLKKQILRTDNISFMLKRCCQPKPR 537
```

FIG. 29 (CONT.¹)

```
  1  MGCVQCKDKEATKLTEERDGSLNQSSGYRYGTDPTPQHYPSFGVTSIPNY   50
     ||||||||||||||||||||||||||||||||||||||||||||||||||
  1  MGCVQCKDKEATKLTEERDGSLNQSSGYRYGTDPTPQHYPSFGVTSIPNY   50

51  NNFHAAGGQGLTVFGGVNSSSHTGTLRTRGGTGVTLFVALYDYEARTEDD  100
     |||||||||||||||||||||||||||||||||||||||||||||||||
 51  NNFHAAGGQGLTVFGGVNSSSHTGTLRTRGGTGVTLFVALYDYEARTEDD  100

101  LSFHKGEKFQILNSSEGDWWEARSLTTGETGYIPSNYVAPVDSIQAEEWY  150
     |||||||||||||||||||||||||||||||||||||||||||||||||
101  LSFHKGEKFQILNSSEGDWWEARSLTTGETGYIPSNYVAPVDSIQAEEWY  150

151  FGKLGRKDAERQLLSFGNPRGTFLIRESETTKGAYSLSIRDWDDMKGDHV  200
     ||||||||||||||||||||||||||||||||||:||||||||||||||
151  FGKLGRKDAERQLLSFGNPRGTFLIRESETTKGSYSLSIRDWDDMKGDHV  200

201  KHYKIRKLDNGGYYITTRAQFETLQQLVQHYSERAAGLCCRLVVPCHKGM  250
     |||||||||||||||||||||||||||||||||||||||||||||||||
201  KHYKIRKLDNGGYYITTRAQFETLQQLVQHYSERAAGLCCRLVVPCHKGM  250

251  PRLTDLSVKTKDVWEIPRESLQLIKRLGNGQFGEVWMG  288
     |||||||||||||||||||||||||||||||||||||
251  PRLTDLSVKTKDVWEIPRESLQLIKRLGNGQFGEVWMG  288
```

FIG. 30

```
  1 MGCVQCKDKEATKLTEERDGSLNQSSGYRYGTDPTPQHYPSFGVTSIPNY  50
    ||||||||||||||||||||||||||||||||||||||||||||||||||
  1 MGCVQCKDKEATKLTEERDGSLNQSSGYRYGTDPTPQHYPSFGVTSIPNY  50

51 NNFHAAGGQGLTVFGGVNSSSHTGTLRTRGGTGVTLFVALYDYEARTEDD 100
    ||||||||||||||||||||||||||||||||||||||||||||||||||
 51 NNFHAAGGQGLTVFGGVNSSSHTGTLRTRGGTGVTLFVALYDYEARTEDD 100

101 LSFHKGEKFQILNSSEGDWWEARSLTTGETGYIPSNYVAPVDSIQAEEWY 150
    ||||||||||||||||||||||||||||||||||||||||||||||||||
101 LSFHKGEKFQILNSSEGDWWEARSLTTGETGYIPSNYVAPVDSIQAEEWY 150

151 FGKLGRKDAERQLLSFGNPRGTFLIRESETTKGAYSLSIRDWDDMKGDHV 200
    |||||||||||||||||||||||||||||||||:|||||||||||||||
151 FGKLGRKDAERQLLSFGNPRGTFLIRESETTKGSYSLSIRDWDDMKGDHV 200

201 KHYKIRKLDNGGYYITTRAQFETLQQLVQHYSERAAGLCCRLVVPCHKGM 250
    ||||||||||||||||||||||||||||||||||||||||||||||||||
201 KHYKIRKLDNGGYYITTRAQFETLQQLVQHYSERAAGLCCRLVVPCHKGM 250
```

FIG. 31

```
251  PRLTDLSVKTKDVWEIPRESLQLIKRLGNGQFGEVWMGTWNGNTKVAIKT  300
     ||||||||||||||||||||||||||||||||||||||||||||||||
251  PRLTDLSVKTKDVWEIPRESLQLIKRLGNGQFGEVWMGTWNGNTKVAIKT  300

301  LKPGTMSPESFLEEAQIMKKLKHDKLVQLYAVVSEEPIYIVTEYMNKG  348
     |||||||||||||||||||||||||||||||||||||||||||||||
301  LKPGTMSPESFLEEAQIMKKLKHDKLVQLYAVVSEEPIYIVTEYMNKG  348
```

FIG. 31 (CONT.¹)

```
 50  SLLELHKRRKALTEPEARYYLRQIVLGCQYLHRNRVIHRDLKLGNLFLNE   99
     |||||||||||||||||||||||||||||||||||||||||||||||||
137  SLLELHKRRKALTEPEARYYLRQIVLGCQYLHRNRVIHRDLKLGNLFLNE  186

100  DLEVKIGDFGLATKVEYDGERKKTLCGTPNYIAPEVLSKKGHSFEVDVWS  149
     |||||||||||||||||||||||||||||||||||||||||||||||||
187  DLEVKIGDFGLATKVEYDGERKKTLCGTPNYIAPEVLSKKGHSFEVDVWS  236

150  IGCIMYTLLVGKPPFETSCLKETYLRIKKNEYSIPKHINPVAASLIQKML  199
     |||||||||||||||||||||||||||||||||||||||||||||||||
237  IGCIMYTLLVGKPPFETSCLKETYLRIKKNEYSIPKHINPVAASLIQKML  286

200  QTDPTARPTINELLNDEFFTSGYIPARLPITCLTIPPRFSIAPSSLDPSN  249
     ||||||||||||||| |||:|||||||||||||||||||||||||||||
287  QTDPTARPTINELLGDEFFTSGYIPARLPITCLTIPPRFSIAPSSLDPSN  336

250  RKPLTVLNKGLENPLPERPREKEEPVVRETGEVVDCHLSDMLQQLHSVNA  299
     |||||||||||||||||||||||||||||||||||||||||||||||||
337  RKPLTVLNKGLENPLPERPREKEEPVVRETGEVVDCHLSDMLQQLHSVNA  386
```

FIG. 32

```
300 SKPSERGLVRQEEAEDPACIPIFWVSKWVDYSDKYGLGYQLCDNSVGVLF 349
    |||||||||||||||||||||||||||||||||||||||||||||||||
387 SKPSERGLVRQEEAEDPACIPIFWVSKWVDYSDKYGLGYQLCDNSVGVLF 436

350 NDSTRLILYNDGDSLQYIERDGTESYLTVSSHPNSLMKKITLLKYFRNYM 399
    |||||||||||||||||||||||||||||||||||||||||||||||||
437 NDSTRLILYNDGDSLQYIERDGTESYLTVSSHPNSLMKKITLLKYFRNYM 486

400 SEHLLKAGANITPREGDELARLPYLRTWFRTRSAIIHLSNGSVQINFFQ 449
    ||||||||:||||||:||||||||||||||||||||||||||||||||
487 SEHLLKAGGNITPRQGDELARLPYLRTWFRTRSAIIHLSNGSVQINFFQ 536

450 DHTKLILCPLMAAVTYIDEKRDFRTYRLSLLEEYGCCKELASRLRYARTM 499
    |||||||||||||||||||||||||||||||||||||||||||||||||
537 DHTKLILCPLMAAVTYIDEKRDFRTYRLSLLEEYGCCKELASRLRYARTM 586

500 VDKLLSSRSASNRLKAS 516
    |||||||||||||||||
587 VDKLLSSRSASNRLKAS 603
```

FIG. 32 (CONT.¹)

```
 22 LGQCWLQGV..........WERXPHSGLLYPLQ....HPPAEFSTYLNFCRS  59
    ||: ||:              :||  :|: :         :||||||||||||||
208 LGSLPWQGLKAATKRQKYERISEKKMSTPIEVLCKGYPSEFSTYLNFCRS 257

60 LRFDDKPDYSYLRQLFRNLFHRQGFSYDYVFDWNMLKFGASSS........ 102
    |||||||||||||||||||||||||||||||||||||||||||: :
258 LRFDDKPDYSYLRQLFRNLFHRQGFSYDYVFDWNMLKFGAARNPEDVDRE 307

103 .QAQPRDSPMTAKGPFCPRPCPCAGPT..............YSPTYWCPA..... 137
     : |:: |   |  :  | | :|              ||
308 RREHEREERMGQLRGSATRALPPGPPTGATANRLRSAAEPVASTPASRIQ 357

138 PLGTQSPPDRPVEEVE 153
    |: || |    |:::|:
358 PAGNTSP..RAISRVD 371
```

FIG. 33

```
 32 ERGLTVAFSILCNTLQPEFSTYLNFCRSLRFDDKPDYSYLRQLFRNLFHR  81
    |: ::: ::::||:         ||||||||||||||||||||||||||
230 EKKMSTPIEVLCKGYPSEFSTYLNFCRSLRFDDKPDYSYLRQLFRNLFHR 279

82 QGFSYDYVFDWNMLKFGASSSQAQPRD 108
    ||||||||||||||||||||: : |:|
280 QGFSYDYVFDWNMLKFGAARN...PED 303
```

FIG. 34

```
 32 ERGLTVAFSILCNTLQPEFSTYLNFCRSLRFDDKPDYSYLRQLFRNLFHR  81
    |: ::: ::||:       ||||||||||||||||||||||||||||||
230 EKKMSTPIEVLCKGYPSEFSTYLNFCRSLRFDDKPDYSYLRQLFRNLFHR 279

82 QGFSYDYVFDWNMLKFG..................GPL.SCQPPALP 109
    ||||||||||||||||                   |:|  |||
280 QGFSYDYVFDWNMLKFGAARNPEDVDRERREHEREERMGQLRGSATRALP 329

110 CGRPQDELGCSPESRGCGPGAARTRTRGEDGAATGVRDPSPAPWPTHGGH 159
    |  |   | |:|   :|    |  :  |:|  :: |:   ||   |:
330 PGPP.................TGATANRLRSAAEPVASTPASRIQPA...... GN 361

160 CQPAPQCRRARGFHASLP.HPAGWQYFSQSDLAGR 193
    :|   |   | | ::  | |:||::|
362 TSPRAISRVDRERKVSMRLHRGAPANVSSSDLTGR 396
```

FIG. 35

167 MLPEDKEADSLRGNISVKAVKKEVEKKLRCLLADLPLPPELPGGDDLSKS 216
    |||||||||||||||||||||||||||||||||||||||||||||||||
  1 MLPEDKEADSLRGNISVKAVKKEVEKKLRCLLADLPLPPELPGGDDLSKS 50

217 PEEKKTATQLHSKRRPK 233
    ||||||:||||||||||
 51 PEEKKTTTQLHSKRRPK 67

FIG. 36

```
  1 MSAKVRLKKLEQLLLDGPWRNESALSVETLLDVLVCLYTECSHSALRRDK    50
    ||||||||||||||||||||||||||||||||||||||||||||||||||
  1 MSAKVRLKKLEQLLLDGPWRNESALSVETLLDVLVCLYTECSHSALRRDK    50

51 YVAEFLEWAKPFTQLVKEMQLHREDFEIIKVIGRGAFGEVAVVKMKNTER   100
    ||||||||||||||||||||||||||||||||||||||||||||||||||
 51 YVAEFLEWAKPFTQLVKEMQLHREDFEIIKVIGRGAFGEVAVVKMKNTER   100

101 IYAMKILNKWEMLKRAETACFREERDVLVNGDCQWITALHYAFQDENHLY   150
    ||||||||||||||||||||||||||||||||||||||||||||||||||
101 IYAMKILNKWEMLKRAETACFREERDVLVNGDCQWITALHYAFQDENHLY   150

151 LVMDYYVGGDLLTLLSKFEDKLPEDMARFYIGEMVLAIDSIHQLHYVHRD   200
    ||||||||||||||||||||||||||||||||||||||||||||||||||
151 LVMDYYVGGDLLTLLSKFEDKLPEDMARFYIGEMVLAIDSIHQLHYVHRD   200

201 IKPDNVLLDVNGHIRLADFGSCLKMNDDGTVQSSVAVGTPDYISPEILQA   250
    ||||||||||||||||||||||||||||||||||||||||||||||||||
201 IKPDNVLLDVNGHIRLADFGSCLKMNDDGTVQSSVAVGTPDYISPEILQA   250
```

FIG. 37

251 MEDGMGKYGPECDWWSLGVCMYEMLYGETPFYAESLVETYGKIMNHEERF 300
    ||||||||||||||||||||||||||||||||||||||||||||||||||
251 MEDGMGKYGPECDWWSLGVCMYEMLYGETPFYAESLVETYGKIMNHEERF 300

301 QFPSHVTDVSEEAKDLIQRLSC 322
    |||||||||||||||||||| |
301 QFPSHVTDVSEEAKDLIQRLIC 322

FIG. 37 (CONT.$^1$)

```
  1  MSAKVRLKKLEQLLLDGPWRNESALSVETLLDVLVCLYTECSHSALRRDK   50
     ||||||||||||||||||||||||||||||||||||||||||||||||||
  1  MSAKVRLKKLEQLLLDGPWRNESALSVETLLDVLVCLYTECSHSALRRDK   50

51  YVAEFLEWAKPFTQLVKEMQLHREDFEIIKVIGRGAFGEVAVVKMKNTER  100
     |||||||||||||||||||||||||||||||||||||||||||||||||
 51  YVAEFLEWAKPFTQLVKEMQLHREDFEIIKVIGRGAFGEVAVVKMKNTER  100

101  IYAMKILNKWEMLKRAETACFREERDVLVNGDCQWITALHYAFQDENHLY  150
     |||||||||||||||||||||||||||||||||||||||||||||||||
101  IYAMKILNKWEMLKRAETACFREERDVLVNGDCQWITALHYAFQDENHLY  150

151  LVMDYYVGGDLLTLLSKFEDKLPEDMARFYIGEMVLAIDSIHQLHYVHRD  200
     |||||||||||||||||||||||||||||||||||||||||||||||||
151  LVMDYYVGGDLLTLLSKFEDKLPEDMARFYIGEMVLAIDSIHQLHYVHRD  200

201  IKPDNVLLDVNGHIRLADFGSCLKMNDDGTV  231
     |||||||||||||||||||||||||||||||
201  IKPDNVLLDVNGHIRLADFGSCLKMNDDGTV  231
```

FIG. 38

```
  1  MELRVGNRYRLGRKIGSSFGDIYL.................      25
     |||||||||||||||||||||||
  1  MELRVGNRYRLGRKIGSSFGDIYLGTDIAAGEEVAIKLECVKTKHPQLH 50

26  ........................VGIPTIRWCGAEGDYNVMVMELLGPSLEDLFNFCSRKF  63
                             |||||||||||||||||||||||||||||||||||||
 51  IESKIYKMMQGGVGIPTIRWCGAEGDYNVMVMELLGPSLEDLFNFCSRKF 100

64  SLKTVLLLADQMISRIEYIHSKNFIHRDVKPDNFLMGLGKKGNLVYIIDF 113
     |||||||||||||||||||||||||||||||||||||||||||||||||
101  SLKTVLLLADQMISRIEYIHSKNFIHRDVKPDNFLMGLGKKGNLVYIIDF 150

114  GLAKKYRDARTHQHIPYRENKNLTGTARYASINTHLGIEQSRRDDLESLG 163
     |||||||||||||||||||||||||||||||||||||||||||||||||
151  GLAKKYRDARTHQHIPYRENKNLTGTARYASINTHLGIEQSRRDDLESLG 200

164  YVLMYFNLGSLPWQGLKAATKRQKYERISEKKMSTPIEVLCKGYPSEFAT 213
     |||||||||||||||||||||||||||||||||||||||||||||||||
201  YVLMYFNLGSLPWQGLKAATKRQKYERISEKKMSTPIEVLCKGYPSEFAT 250
```

FIG. 39

```
214 YLNFCRSLRFDDKPDYSYLRQLFRNLFHRQGFSYDYVFDWNMLKFGASRA 263
    |||||||||||||||||||||||||||||||||||||||||||||||||
251 YLNFCRSLRFDDKPDYSYLRQLFRNLFHRQGFSYDYVFDWNMLKFGASRA 300

264 ADDAERDAGDREERLRHSRNPATRGLPSTASGRLRGRRKVAPPTPLTPTS 313
    ||||| :: |||||||||||||||||||| ||||||  ::|||||||||
301 ADDAERRDREERLRHSRNPATRGLPSTDSGRLRGTQEVAPPTPLTPTS 350

314 HTANTSPRPVSGMERERKVSMRLHRGAPVNISSSDLTGRQDTSRMSTSQI 363
    |||||||||||||||||||||||||||||||||||||||||||||||||
351 HTANTSPRPVSGMERERKVSMRLHRGAPVNISSSDLTGRQDTSRMSTSQI 400

364 PGRVASSGLQSVVHR 378
    |||||||||||||||
401 PGRVASSGLQSVVHR 415
```

FIG. 39 (CONT.¹)

```
  14 TFAAPSFDDKILEVVAVFGSMQMAVSRVIRLQHHRIAQCRTVKISILGDE    63
     |||||||||||||||||||||||||||||||||||||||||||||||||
 817 TFAAPSFDDKILEVVAVFGSMQMAVSRVIRLQHHRIAQCRTVKISILGDE   866

64 GVPVQVDGEAWVQPPGYIRIVHKNRAQTLTRDRAFESTLKSWEDKQKCEL   113
     |||||||||||||||||||||||||||||||||||||||||||||||| :
 867 GVPVQVDGEAWVQPPGYIRIVHKNRAQTLTRDRAFESTLKSWEDKQKCEV   916

114 PRPPSCSLHPEMLSEEEATQMDQFGQAAGVLIHSIREIAQSHRDMEQELA   163
     |||||||||||||||||||||||||||||||||||||||||||||||||
 917 PRPPSCSLHPEMLSEEEATQMDQFGQAAGVLIHSIREIAQSHRDMEQELA   966

164 HAVNASSKSMDRVYGKPRTTEGLNCSFVLEMVNNFRALRSETELLLSGKM   213
     ||||||||||||||||||||||||||||||||||||||||||| |||||
 967 HAVNASSKSMDRVYGKPRTTEGLNCSFVLEMVNNFRALRSETE.LLSGKM  1015

214 ALQLDPPQKEQLGSALAEMDRQLRRLADTPWLCQSAEPGDEESVMLDLAK   263
     |||||||||||||||||||||||||||||||||||||||||||||||||
1016 ALQLDPPQKEQLGSALAEMDRQLRRLADTPWLCQSAEPGDEESVMLDLAK  1065
```

FIG. 40

```
 264  RSRSGKFRLVTKFKKEKNNKNKEAHSSLGAPVHLWGTEEVAAWLEHLSLC  313
      |||||||||||||||||||||||||||||||||||||||||||||||||
1066  RSRSGKFRLVTKFKKEKNNKNKEAHSSLGAPVHLWGTEEVAAWLEHLSLC 1115

314  EYKDIFTRHDIRGSELLHLERRDLKDLGVTKVGHMKRILCGIKELSRSAP  363
      |||||||||||||||||||||||||||||||||||||||||||||||||
1116  EYKDIFTRHDIRGSELLHLERRDLKDLGVTKVGHMKRILCGIKELSRSAP 1165

364 AVEA 367
          ||||
     1166 AVEA 1169
```

FIG. 40 (CONT.¹)

```
  1 MSDVAIVKEGWLHKRGEYIKTWRPRYFLLKNDGTFIGYKERPQDVDQREA   50
    ||||||||||||||||||||||||||||||||||||||||||||||||||
  1 MSDVAIVKEGWLHKRGEYIKTWRPRYFLLKNDGTFIGYKERPQDVDQREA   50

51 PLNNFSVAQCQLMKTERPRPNTFIIRCLQWTTVIERTFHVETPEEREEWT  100
    ||||||||||||||||||||||||||||||||||||||||||||||||||
 51 PLNNFSVAQCQLMKTERPRPNTFIIRCLQWTTVIERTFHVETPEEREEWT  100

101 TAIQTVADGLKKQEEEMDFRSGSPSDNSGAEEMEVSLAKPKHRVAL      147
    |||||||||||||||||||||||||||||||||||||||||||::
101 TAIQTVADGLKKQEEEMDFRSGSPSDNSGAEEMEVSLAKPKHRVTM      147
```

FIG. 41

```
  1 MIVHDDVESEPAMTPSKEGTLIVRQTQSASSTLQKHKSSSSFTPFIDPRL   50
    ||||||||||||||||||||||||||||||||||||||||||||||||||
751 MIVHDDVESEPAMTPSKEGTLIVRQTQSASSTLQKHKSSSSFTPFIDPRL  800

51 LQISPSSGTTVTSVVGFSCDGMRPEAIRQDPTRKGSVVNVNPTNTRPQSD  100
    ||||||||||||||||||||||||||||||||||||||||||||||||||
801 LQISPSSGTTVTSVVGFSCDGMRPEAIRQDPTRKGSVVNVNPTNTRPQSD  850

101 TPEIRKYKKRFNSEILCAALWGVNLLVGTESGLMLLDRSGQGKVYPLINR  150
    ||||||||||||||||||||||||||||||||||||||||||||||||||
851 TPEIRKYKKRFNSEILCAALWGVNLLVGTESGLMLLDRSGQGKVYPLINR  900

151 RRFQQMDVLEGLNVLVTISGKKDKLRVYYLSWLRNKILHNDPEVEKKQGW  200
    ||||||||||||||||||||||||||||||||||||||||||||||||||
901 RRFQQMDVLEGLNVLVTISGKKDKLRVYYLSWLRNKILHNDPEVEKKQGW  950

201 TTVGDLEGCVHYKVVKYERIKFLVIALKSSVEVYAWAPKPYHKFMAFKSF  250
    ||||||||||||||||||||||||||||||||||||||||||||||||||
951 TTVGDLEGCVHYKVVKYERIKFLVIALKSSVEVYAWAPKPYHKFMAFKSF 1000
```

FIG. 42

```
 251 GELVHKPLLVDLTVEEGQRLKVIYGSCAGFHAVDVDSGSVYDIYLPTHIQ  300
     |||||||||||||||||||||||||||||||||||||||||||||||||
1001 GELVHKPLLVDLTVEEGQRLKVIYGSCAGFHAVDVDSGSVYDIYLPTHIQ 1050

301 CSIKPHAIILPNTDGMELLVCYEDEGVYVNTYGRITKDVVLQWGEMPTS   350
     |||||||||||||||||||||||||||||||||||||||||||||||||
1051 CSIKPHAIILPNTDGMELLVCYEDEGVYVNTYGRITKDVVLQWGEMPTS  1100

351 VAYIRSNQTMGWGEKAIEIRSVETGHLDGVFMHKRAQRLKFLCERNDKVF  400
     |||||||||||||||||||||||||||||||||||||||||||||||||
1101 VAYIRSNQTMGWGEKAIEIRSVETGHLDGVFMHKRAQRLKFLCERNDKVF 1150

401 FASVRSGGSSQVYFMTLGRTSLLSW  425
     |||||||||||||||||||||||||
1151 FASVRSGGSSQVYFMTLGRTSLLSW 1175
```

FIG. 42 (CONT.¹)

```
 14 GEVDLTALAKELRAVEDVRPPHKVTDYSSSSEESGTTDEEDDDVEQEGAD  63
    ||||||||||||||||||||||||||||||||||||||||||||||||||
674 GEVDLTALAKELRAVEDVRPPHKVTDYSSSSEESGTTDEEDDDVEQEGAD 723

64 ESTSGPEDTRAASSLNLSNGETESVKTMIVHDDVESEPAMTPSKEGTLIV 113
    ||||||||||||||||||||||||||||||||||||||||||||||||||
724 ESTSGPEDTRAASSLNLSNGETESVKTMIVHDDVESEPAMTPSKEGTLIV 773

114 RQTQSASSTLQKHKSSSSFTPFIDPRLLQISPSSGTTVTSVVGFSCDGMR 163
    ||||||||||||||||||||||||||||||||||||||||||||||||||
774 RQTQSASSTLQKHKSSSSFTPFIDPRLLQISPSSGTTVTSVVGFSCDGMR 823

164 PEAIRQDPTRKGSVVNVNPTNTRPQSDTPEIRKYKKRFNSEILCAALWGV 213
    ||||||||||||||||||||||||||||||||||||||||||||||||||
824 PEAIRQDPTRKGSVVNVNPTNTRPQSDTPEIRKYKKRFNSEILCAALWGV 873

214 NLLVGTESGLMLLDRSGQGKVYPLINRRRFQQMDVLEGLNVLVTISGKKD 263
    ||||||||||||||||||||||||||||||||||||||||||||||||||
874 NLLVGTESGLMLLDRSGQGKVYPLINRRRFQQMDVLEGLNVLVTISGKKD 923

264 KLRVYYLSWLRNKILHNDPEVEKKQGWTTVGDLEGCVHYKVVKYERIKFL 313
    ||||||||||||||||||||||||||||||||||||||||||||||||||
924 KLRVYYLSWLRNKILHNDPEVEKKQGWTTVGDLEGCVHYKVVKYERIKFL 973
```

FIG. 43

```
314  VIALKSSVEVYAWAPKPYHKFMAFKSFGELVHKPLLVDLTVEEGQRLKVI  363
     |||||||||||||||||||||||||||||||||||||||||||||||||
974  VIALKSSVEVYAWAPKPYHKFMAFKSFGELVHKPLLVDLTVEEGQRLKVI  1023

364  YGSCAGFHAVDVDSGSVYDIYLPTHIQCSIKPHAIIILPNTDGMELLVCY  413
     |||||||||||||||||||||||||||||||||||||||||||||||||
1024 YGSCAGFHAVDVDSGSVYDIYLPTHIQCSIKPHAIIILPNTDGMELLVCY  1073

414  EDEGVYVNTYGRITKDVVLQWGEMPTSVAYIRSNQTMGWGEKAIEIRSVE  463
     |||||||||||||||||||||||||||||||||||||||||||||||||
1074 EDEGVYVNTYGRITKDVVLQWGEMPTSVAYIRSNQTMGWGEKAIEIRSVE  1123

464  TGHLDGVFMHKRAQRLKFLCERNDKVFFASVRSGGSSQVYFMTLGRTSLL  513
     |||||||||||||||||||||||||||||||||||||||||||||||||
1124 TGHLDGVFMHKRAQRLKFLCERNDKVFFASVRSGGSSQVYFMTLGRTSLL  1173

```
 64 LTANETQSASSTLQKHKSSSSFTPFIDPRLLQISPSSGTTVTSVVGFSCD 113
    |  : :|||||||||||||||||||||||||||||||||||||||||||||
771 LIVRQTQSASSTLQKHKSSSSFTPFIDPRLLQISPSSGTTVTSVVGFSCD 820

114 GMRPEAIRQDPTRKGSVVNVNPTNTRPQSDTPEIRKYKKRFNSEILCAAL 163
    ||||||||||||||||||||||||||||||||||||||||||||||||||
821 GMRPEAIRQDPTRKGSVVNVNPTNTRPQSDTPEIRKYKKRFNSEILCAAL 870

164 WGVNLLVGTESGLMLLDRSGQGKVYPLINRRFQQMDVLEGLNVLVTISG 213
    |||||||||||||||||||||||||||||||||||||||||||||||||
871 WGVNLLVGTESGLMLLDRSGQGKVYPLINRRFQQMDVLEGLNVLVTISG 920

214 KKDKLRVYYLSWLRNKILHNDPEVEKKQGWTTVGDLEGCVHYKVVKYERI 263
    ||||||||||||||||||||||||||||||||||||||||||||||||||
921 KKDKLRVYYLSWLRNKILHNDPEVEKKQGWTTVGDLEGCVHYKVVKYERI 970

264 KFLVIALKSSVEVYAWAPKPYHKFMAFKSFGELVHKPLLVDLTVEEGQRL 313
    ||||||||||||||||||||||||||||||||||||||||||||||||||
971 KFLVIALKSSVEVYAWAPKPYHKFMAFKSFGELVHKPLLVDLTVEEGQRL 1020
```

FIG. 44

```
 314 KVIYGSCAGFHAVDVDSGSVYDIYLPTHIQCSIKPHAIIILPNTDGMELL 363
     |||||||||||||||||||||||||||||||||||||||||||||||||
1021 KVIYGSCAGFHAVDVDSGSVYDIYLPTHIQCSIKPHAIIILPNTDGMELL 1070

364 VCYEDEGVYVNTYGRITKDVVLQWGEMPTSVAYIRSNQTMGWGEKAIEIR 413
     |||||||||||||||||||||||||||||||||||||||||||||||||
1071 VCYEDEGVYVNTYGRITKDVVLQWGEMPTSVAYIRSNQTMGWGEKAIEIR 1120

414 SVETGHLDGVFMHKRAQRLKFLCERNDKVFFASVRSGGSSQVYFMTLGRT 463
     |||||||||||||||||||||||||||||||||||||||||||||||||
1121 SVETGHLDGVFMHKRAQRLKFLCERNDKVFFASVRSGGSSQVYFMTLGRT 1170

464 SLLSW 468
     |||||
1171 SLLSW 1175
```

FIG. 44 (CONT.¹)

```
  1 MDCQLSILLLLSCSVLDSFGELIPQPSNEVNLLDSKTIQGELGWISYPSH  50
    ||||||||||||||||||||||||||||||||||||||||||||||||||
  1 MDCQLSILLLLSCSVLDSFGELIPQPSNEVNLLDSKTIQGELGWISYPSH  50

51 GWEEISGVDEHYTPIRTYQVCNVMDHSQNNWLRTNWVPRNSAQKIYVELK 100
    ||||||||||||||||||||||||||||||||||||||||||||||||||
 51 GWEEISGVDEHYTPIRTYQVCNVMDHSQNNWLRTNWVPRNSAQKIYVELK 100

101 FTLRDCNSIPLVLGTCKETFNLYYMESDDDHGVKFREHQFTKIDTIAADE 150
    ||||||||||||||||||||||||||||||||||||||||||||||||||
101 FTLRDCNSIPLVLGTCKETFNLYYMESDDDHGVKFREHQFTKIDTIAADE 150

151 SFTQMDLGDRILKLNTEIREVGPVNKKGFYLAFQDVGACVALVSVRVYFK 200
    ||||||||||||||||||||||||||||||||||||||||||||||||||
151 SFTQMDLGDRILKLNTEIREVGPVNKKGFYLAFQDVGACVALVSVRVYFK 200

201 KCPFTVKNLAMFPDTVPMDSQSLVEVRGSCVNNSKEEDPPRMYCSTEGEW 250
    ||||||||||||||||||||||||||||||||||||||||||||||||||
201 KCPFTVKNLAMFPDTVPMDSQSLVEVRGSCVNNSKEEDPPRMYCSTEGEW 250
```

FIG. 45

```
251  LVPIGKCSCNAGYEERGFMCQACRPGFYKALDGNMKCAKCPPHSSTQEDG  300
     |||||||||||||||||||||||||||||||||||||||||||||||||
251  LVPIGKCSCNAGYEERGFMCQACRPGFYKALDGNMKCAKCPPHSSTQEDG  300

301  SMNCRCENNYFRADKDPPSMACTRPPSSPRNVISNINETSVILDWSWPLD  350
     |||||||||||||||||||||||||||||||||||||||||||||||||
301  SMNCRCENNYFRADKDPPSMACTRPPSSPRNVISNINETSVILDWSWPLD  350

351  TGGRKDVTFNIICKKCGWNIKQCEPCSPNVRFLPRQFGLTNTTVTVTDLL  400
     |||||||||||||||||||||||||||||||||||||||||||||||||
351  TGGRKDVTFNIICKKCGWNIKQCEPCSPNVRFLPRQFGLTNTTVTVTDLL  400

401  AHTNYTFEIDAVNGVSELSSPPRQFAAVSITTNQAAPSPVLTIKKDRTSR  450
     |||||||||||||||||||||||||||||||||||||||||||||||||
401  AHTNYTFEIDAVNGVSELSSPPRQFAAVSITTNQAAPSPVLTIKKDRTSR  450

451  NSISLSWQEPEHPNGIILDYEVKYYEKQEQETSYTILRARGTNVTISSLK  500
     |||||||||||||||||||||||||||||||||||||||||||||||||
451  NSISLSWQEPEHPNGIILDYEVKYYEKQEQETSYTILRARGTNVTISSLK  500
```

FIG. 45 (CONT.¹)

```
501  PDTIYVFQIRARTAAGYGTNSRKFEFETSPDSFSISGESSQVVMIAISAA  550
     |||||||||||||||||||||||||||||||||||||||||||||||||||
501  PDTIYVFQIRARTAAGYGTNSRKFEFETSPDSFSISGESSQVVMIAISAA  550

551  VAIILLTVVIYVLIGRFCGYKSKHGADEKRLHFGNGHLKLPGLRTYVDPH  600
     |||||||||||||||||||||||||||||||||||||||||||||||||||
551  VAIILLTVVIYVLIGRFCGYKSKHGADEKRLHFGNGHLKLPGLRTYVDPH  600

601  TYEDPTQAVHEFAKELDATNISIDKVVGA  629
     |||||||||||||||||||||||||||||
601  TYEDPTQAVHEFAKELDATNISIDKVVGA  629
```

FIG. 45 (CONT.$^2$)

```
  6  WGWVAVVKLKNADKVFAMKILNKWEMLKRAETACFREERDVLVNGDNKWI    55
     :|  ||||||||||||||||||||||||||||||||||||||||||||||
 88  FGEVAVVKLKNADKVFAMKILNKWEMLKRAETACFREERDVLVNGDNKWI   137

56  TTLHYAFQDDNNLYLVMDYYVGGDLLTLLSKFEDRLPEDMARFYLAEMVI   105
     |||||||||||||||||||||||||||||||||||||||||||||||||
138  TTLHYAFQDDNNLYLVMDYYVGGDLLTLLSKFEDRLPEDMARFYLAEMVI   187

106  AIDSVHQLHYVHRDIKPDNILMDMNGHIRLADFGSCLKLMEDGTVQSSVA   155
     |||||||||||||||||||||||||||||||||||||||||||||||||
188  AIDSVHQLHYVHRDIKPDNILMDMNGHIRLADFGSCLKLMEDGTVQSSVA   237

156  VGTPDYISPEILQAMEDGKGRYGPECDWWSLGVCMYEMLYGETPFYAESL   205
     |||||||||||||||||||||||||||||||||||||||||||||||||
238  VGTPDYISPEILQAMEDGKGRYGPECDWWSLGVCMYEMLYGETPFYAESL   287

206  VETYGKIMNHKERFQFPAQVTDVSENAKDLIRRLICSREHRLGQNGIEDF   255
     |||||||||||||||||||||||||||||||||||||||||||||||||
288  VETYGKIMNHKERFQFPAQVTDVSENAKDLIRRLICSREHRLGQNGIEDF   337
```

FIG. 46

```
256 KKHPFFSGIDWDNIRNCEAPYIPEVSSPTDTSNFDVDDDCLKNSETMPPP 305
    ||||||||||||||||||||||||||||||||||||||||||||||||||
338 KKHPFFSGIDWDNIRNCEAPYIPEVSSPTDTSNFDVDDDCLKNSETMPPP 387

306 THTAFSGHHLPFVGFTYTSSCVLSDRSCLRVTAGPTSLDLDVNVQRTLDN 355
    ||||||||||||||||||||||||||||||||||||||||||||||||||
388 THTAFSGHHLPFVGFTYTSSCVLSDRSCLRVTAGPTSLDLDVNVQRTLDN 437

356 NLATEAYERRIKRLEQEKLELSRKLQESTQTVQALQYSTVDGPLTASKDL 405
    ||||||||||||||||||||||||||||||||||||||||||||||||||
438 NLATEAYERRIKRLEQEKLELSRKLQESTQTVQALQYSTVDGPLTASKDL 487

406 EIKNLKEEI 414
    |||||||||
488 EIKNLKEEI 496
```

FIG. 46 (CONT.¹)

```
  1 MEVVDPQQLGMFTEGELMSVGMDTFIHRIDSTEVIYQPRRKRAKLIGKYL  50
    |||||||||||||||||||||||||||||||||||||||||||||||||
  1 MEVVDPQQLGMFTEGELMSVGMDTFIHRIDSTEVIYQPRRKRAKLIGKYL  50

51 MGDLLGEGSYGKVKEVLDSETLCRRAVKILKKKKLRRIPNGEANVKKEIQ 100
    |||||||||||||||||||||||||||||||||||||||||||||||||
 51 MGDLLGEGSYGKVKEVLDSETLCRRAVKILKKKKLRRIPNGEANVKKEIQ 100

101 LLRRLRHKNVIQLVDVLYNEEKQKMYMVMEYCVCGMQEMLDSVPEKRFPV 150
    |||||||||||||||||||||||||||||||||||||||||||||||||
101 LLRRLRHKNVIQLVDVLYNEEKQKMYMVMEYCVCGMQEMLDSVPEKRFPV 150

151 CQAHG 155
    |||||
151 CQAHG 155
```

FIG. 47

```
  1 MEVVDPQQLGMFTEGELMSVGMDTFIHRIDSTEVIYQPRRKRAKLIGKYL  50
    ||||||||||||||||||||||||||||||||||||||||||||||||||
  1 MEVVDPQQLGMFTEGELMSVGMDTFIHRIDSTEVIYQPRRKRAKLIGKYL  50

51 MGDLLGEGSYGKVKEVLDSETLCRRAVKILKKKKLRRIPNGEANVKKEIQ 100
    ||||||||||||||||||||||||||||||||||||||||||||||||||
 51 MGDLLGEGSYGKVKEVLDSETLCRRAVKILKKKKLRRIPNGEANVKKEIQ 100

101 LLRRLRHKNVIQLVDVLYNEEKQKMYMVMEYCVCGMQEMLDSVPEKRFPV 150
    ||||||||||||||||||||||||||||||||||||||||||||||||||
101 LLRRLRHKNVIQLVDVLYNEEKQKMYMVMEYCVCGMQEMLDSVPEKRFPV 150

151 CQAHGYFCQLIDGLEYLHSQGIVHKDIKPGNLLLTTGGTLKISDLGVAE  199
    ||||||||||||||||||||||||||||||||||||||||||||||||
151 CQAHGYFCQLIDGLEYLHSQGIVHKDIKPGNLLLTTGGTLKISDLGVAE  199
```

FIG. 48

```
 27 VKDFLSQLRSNRRFSIPESGQGGTEMDGFRRTIENQHSRNDVMVSEWLN  76
    ||||||||:|||||||||||||||||||||||||||||||||||||||||
301 VKDFLSQLKSSNRRFSIPESGQGGTEMDGFRRTIENQHSRNDVMVSEWLN 350

77 KLNLEEPPSSVPKKCPSLTKRSRAQEEQVPQAWTAGTSSDSMAQPPQTPE 126
    ||||||||||||||||||||||||||||||||||||||||||||||||||
351 KLNLEEPPSSVPKKCPSLTKRSRAQEEQVPQAWTAGTSSDSMAQPPQTPE 400

127 TSTFRNQMPSPTSTGTPSPGPRGNQGAERQGMNWSCRTPEPNPVTGRPLV 176
    ||||||||||||||||||||||||||||||||||||||||||||||||||
401 TSTFRNQMPSPTSTGTPSPGPRGNQGAERQGMNWSCRTPEPNPVTGRPLV 450

177 NIYNCSGVQVGDNNYLTMQQTTALPTWGLAPSGKGRGLQHPPPVGSQEGP 226
    ||||||||||||||||||||||||||||||||||||||||||||||||||
451 NIYNCSGVQVGDNNYLTMQQTTALPTWGLAPSGKGRGLQHPPPVGSQEGP 500

227 KDPEAWSRPQGWYNHSGK 244
    ||||||||||||||||||
501 KDPEAWSRPQGWYNHSGK 518
```

FIG. 49

```
 30  EEQARELYRRLREKPRDQRTEGDSQEMVRLLLQAIQSFEKKVRVIYTQLS  79
     |||||||||||||||||||||||||||||||||||||||||||||||||
564  EEQARELYRRLREKPRDQRTEGDSQEMVRLLLQAIQSFEKKVRVIYTQLS  613

80  KTVVCKQKALELLPKVEEVVSLMNEDEKTVVRLQEKRQKELWNLLKIACS  129
     |||||||||||||||||||||||||||||||||||||||||||||||||
614  KTVVCKQKALELLPKVEEVVSLMNEDEKTVVRLQEKRQKELWNLLKIACS  663

130  KVRGPVSGSPDSMNASRLSQPGQLMSQPSTASNSLPEPAKKSEELVAEAH  179
     |||||||||||||||||||||||||||||||||||||||||||||||||
664  KVRGPVSGSPDSMNASRLSQPGQLMSQPSTASNSLPEPAKKSEELVAEAH  713

180  NLCTLLENAIQDTVREQDQSFTALDWSWLQTEEEEHSCLEQAS  222
     ||||||||||||||||||||||||||||||||||||||||||
714  NLCTLLENAIQDTVREQDQSFTALDWSWLQTEEEEHSCLEQAS  756
```

FIG. 50

```
  1 MRLTLLCCTWREERMGEEGSELPVCASCGQRIYDGQYLQALNADWHADCF  50
    ||||||||||||||||||||||||||||||||||||||||||||||||||
  1 MRLTLLCCTWREERMGEEGSELPVCASCGQRIYDGQYLQALNADWHADCF  50

51 RCCDCSASLSHQYYEKDGQLFCKKDYWARYGESCHGCSEQITKGLVMVAG 100
    ||||||||||||||||||||||||||||||||||||||||||||||||||
 51 RCCDCSASLSHQYYEKDGQLFCKKDYWARYGESCHGCSEQITKGLVMVAG 100

101 ELKYHPECFICLTCGTFIGDGDTYTLVEHSKLYCGHCYYQTVVTPVIEQI 150
    ||||||||||||||||||||||||||||||||||||||||||||||||||
101 ELKYHPECFICLTCGTFIGDGDTYTLVEHSKLYCGHCYYQTVVTPVIEQI 150

151 LPDSPGSHLPHTVTLVSIPASSHGKRGLSVSIDPPHGPPGCGTEHSHTVR 200
    ||||||||||||||||||||||||||||||||||||||||||||||||||
151 LPDSPGSHLPHTVTLVSIPASSHGKRGLSVSIDPPHGPPGCGTEHSHTVR 200

201 VQGVDPGCMSPDVKNSIHVGDRILEINGTPIRNVPLDEIDLLIQETSRLL 250
    ||||||||||||||||||||||||||||||||||||||||||||||||||
201 VQGVDPGCMSPDVKNSIHVGDRILEINGTPIRNVPLDEIDLLIQETSRLL 250
```

FIG. 51

```
251 QLTLEHDPHDTLGHGLPETSPLSSPAYTPSGEAGSSARQKPVLRSCSID 300
    ||||||||||||||||||||||||||||||||||||||||||||||||
251 QLTLEHDPHDTLGHGLPETSPLSSPAYTPSGEAGSSARQKPVLRSCSID 300

301 RSPGAGSLGSPASQRKDLGRSESLRVVCRPHRIFRPSDLIHGEVLGKGCF 350
    |||||||||||||||||||||||||||||||||||||||||||||||||
301 RSPGAGSLGSPASQRKDLGRSESLRVVCRPHRIFRPSDLIHGEVLGKGCF 350

351 GQAIKV 356
    ||||||
351 GQAIKV 356
```

FIG. 51 (CONT.¹)

```
  1 MRLTLLCCTWREERMGEEGSELPVCASCGQRIYDGQYLQALNADWHADCF  50
    ||||||||||||||||||||||||||||||||||||||||||||||||||
  1 MRLTLLCCTWREERMGEEGSELPVCASCGQRIYDGQYLQALNADWHADCF  50

51 RCCDCSASLSHQYYEKDGQLFCKKDYWARYGESCHGCSEQITKGLVMVAG 100
    ||||||||||||||||||||||||||||||||||||||||||||||||||
 51 RCCDCSASLSHQYYEKDGQLFCKKDYWARYGESCHGCSEQITKGLVMVAG 100

101 ELKYHPECFICLTCGTFIGDGDTYTLVEHSKLYCGHCYYQTVVTPVIEQI 150
    ||||||||||||||||||||||||||||||||||||||||||||||||||
101 ELKYHPECFICLTCGTFIGDGDTYTLVEHSKLYCGHCYYQTVVTPVIEQI 150

151 LPDSPGSHLPHTVTLVSIPASSHGKRGLSVSIDPPHGPPGCGTEHSHTVR 200
    ||||||||||||||||||||||||||||||||||||||||||||||||||
151 LPDSPGSHLPHTVTLVSIPASSHGKRGLSVSIDPPHGPPGCGTEHSHTVR 200

201 VQGVDPGCMSPDVKNSIHVGDRILEINGTPIRNVPLDEIDLLIQETSRLL 250
    ||||||||||||||||||||||||||||||||||||||||||||||||||
201 VQGVDPGCMSPDVKNSIHVGDRILEINGTPIRNVPLDEIDLLIQETSRLL 250
```

FIG. 52

251 QLTLEHDPHDTLGHGLGPETSPLSSPAYTPSGEAGSSARQKPVFARTWVA 300
    |||||||||||||||||||||||||||||||||||||||||||| :  :
251 QLTLEHDPHDTLGHGLGPETSPLSSPAYTPSGEAGSSARQKPVLRSCSID 300

301 LSPSA 305
    ||:|
301 RSPGA 305

FIG. 52 (CONT.¹)

```
  1 MASDAVQSEPRSWSLLEQLGLGAGADLAAPGVQQQLELERERLRREIRKEL  50
    ||||||||||||||||||||||||||||||||||||||||||||||||||
  1 MASDAVQSEPRSWSLLEQLGLGAGADLAAPGVQQQLELERERLRREIRKEL  50

51 KLKEGAENLRRATTDLGRSLGPVELLLRGSSRRLDLLHQQLQELHAHVVL  100
    ||||||||||||||||||||||||||||||||||||||||||||||||||
 51 KLKEGAENLRRATTDLGRSLGPVELLLRGSSRRLDLLHQQLQELHAHVVL  100

101 PDPAATHDGPQSPGAGGPTCSATNLSRVAGLEKQLAIELKVKQGAENMIQ  150
    ||||||||||||||||||||||||||||||||||||||||||||||||||
101 PDPAATHDGPQSPGAGGPTCSATNLSRVAGLEKQLAIELKVKQGAENMIQ  150

151 TYSNGSTKDRKLLLTAQQMLQDSKTKIDIIRMQLRRALQADQLENQAAPD  200
    ||||||||||||||||||||||||||||||||||||||||||||||||||
151 TYSNGSTKDRKLLLTAQQMLQDSKTKIDIIRMQLRRALQAGQLENQAAPD  200

201 DTQGSPDLGAVELRIEELRHHFRVEHAVAEGAKNVLRLLSAAKAPDRKAV  250
    ||||||||||||||||||||||||||||||||||||||||||||||||||
201 DTQGSPDLGAVELRIEELRHHFRVEHAVAEGAKNVLRLLSAAKAPDRKAV  250
```

FIG. 53

```
251  SEAQEKLTESNQKLGLLREALERRLGELPADHPKGRLLREELAAASSAAF  300
     ||||||||||||||||||||||||||||||||||||||||||||||||||
251  SEAQEKLTESNQKLGLLREALERRLGELPADHPKGRLLREELAAASSAAF  300

301  STRLAGPFPATHYSTLCKPAPLTGTLEVRVVGCRDLPETIPWNPTPSMGG  350
     ||||||||||||||||||||||||||||||||||||||||||||||||||
301  STRLAGPFPATHYSTLCKPAPLTGTLEVRVVGCRDLPETIPWNPTPSMGG  350

351  PGTPDSRPPFLSRPARGLYSRSGSLSGRSSLKAEAENTSEVSTVLKLDNT  400
     ||||||||||||||||||||||||||||||||||||||||||||||||||
351  PGTPDSRPPFLSRPARGLYSRSGSLSGRSSLKAEAENTSEVSTVLKLDNT  400

401  VVGQTSWKPCGPNAWDQSFTLELERARELELAVFWRDQRGLCALKFLKLE  450
     ||||||||||||||||||||||||||||||||||||||||||||||||||
401  VVGQTSWKPCGPNAWDQSFTLELERARELELAVFWRDQRGLCALKFLKLE  450

451  DFLDNERHEVQLDMEPQGCLVAEVTFRNPVIERIPRLRRQKKIFSKQQGK  500
     ||||||||||||||||||||||||||||||||||||||||||||||||||
451  DFLDNERHEVQLDMEPQGCLVAEVTFRNPVIERIPRLRRQKKIFSKQQGK  500
```

FIG. 53 (CONT.[1])

```
501 AFQRARQMNIDVATWVRLLRRLLIPNATGTGTFSPGASPGSEARTTGDISV 550
        ||||||||||||||||||||||||||||||||||||||||||||||||||
501 AFQRARQMNIDVATWVRLLRRLLIPNATGTGTFSPGASPGSEARTTGDISV 550

551 EKLNLGTDSDSSPQKSSRDPPSSPSSLSSPIQESTAPELPSETQETPGPA 600
        |||||||||||||||||||||||||||||||||||||||||||||||||
551 EKLNLGTDSDSSPQKSSRDPPSSPSSLSSPIQESTAPELPSETQETPGPA 600

601 LCSPLRKSPLTLEDFKFLAVLGRGHFGKVLLSEFRPSGELFAIKALKKGD 650
        ||||||||||||||||||||||||||||||||||||||||||||||||
601 LCSPLRKSPLTLEDFKFLAVLGRGHFGKVLLSEFRPSGELFAIKALKKGD 650

651 IVARDEVESLMCEKRILAAVTSAGHPFLVNLFGCFQTPEHVCFVMEYSAG 700
        ||||||||||||||||||||||||||||||||||||||||||||||||
651 IVARDEVESLMCEKRILAAVTSAGHPFLVNLFGCFQTPEHVCFVMEYSAG 700

701 GDLMLHIHSDVFSEPRAIFYSAC.......................... 723
        ||||||||||||||||||||||
701 GDLMLHIHSDVFSEPRAIFYSACVVLGLQFLHEHKIVYRDLKLDNLLLDT 750
```

FIG. 53 (CONT.²)

```
723  ..........................................................  723
751  EGYVKIADFGLCKEGMGYGDRTSTFCGTPEFLAPEVLTDTSYTRAVDWWG            800
723  ..........................................................  723
801  LGVLLYEMLVGESPFPGDDEEVFDSIVNDEVRYPRFLSAEAIGIMRRLL             850
724  ................................RLPPPFVPTLSGRTD              738
851  RRNPERRLGSSERDAEDVKKQPFERTLGWEALLARRLPPPFVPTLSGRTD            900
                                     ||||||||||||||||
739  VSNFDEEFTGEAPTLSPPRDARPLTAAEQAAFLDEFVAGGC                     780
     ||||||||||||||||||||||||||||||||||||||||
901  VSNFDEEFTGEAPTLSPPRDARPLTAAEQAAFLDEFVAGGC                     942
```

FIG. 53 (CONT.³)

```
  1 MASDAVQSEPRSWSLLEQLGLGAGADLAAPGVQQQLELERERLRREIRKEL  50
    ||||||||||||||||||||||||||||||||||||||||||||||||||
  1 MASDAVQSEPRSWSLLEQLGLGAGADLAAPGVQQQLELERERLRREIRKEL  50

51 KLKEGAENLRRATTDLGRSLGPVELLLRGSSRRLDLLHQQLQELHAHVVL  100
    |||||||||||||||||||||||||||||||||||||||||||||||||
 51 KLKEGAENLRRATTDLGRSLGPVELLLRGSSRRLDLLHQQLQELHAHVVL  100

101 PDPAATHDGPQSPGAGGPTCSATNLSRVAGLEKQLAIELKVKQGAENMIQ  150
    |||||||||||||||||||||||||||||||||||||||||||||||||
101 PDPAATHDGPQSPGAGGPTCSATNLSRVAGLEKQLAIELKVKQGAENMIQ  150

151 TYSNGSTKDRKLLLTAQQMLQDSKTKIDIIRMQLRRALQADQLENQAAPD  200
    |||||||||||||||||||||||||||||||||||||||||||||||||
151 TYSNGSTKDRKLLLTAQQMLQDSKTKIDIIRMQLRRALQAGQLENQAAPD  200

201 DTQGSPDLGAVELRIEELRHHFRVEHAVAEGAKNVLRLLSAAKAPDRKAV  250
    |||||||||||||||||||||||||||||||||||||||||||||||||
201 DTQGSPDLGAVELRIEELRHHFRVEHAVAEGAKNVLRLLSAAKAPDRKAV  250
```

FIG. 54

```
251 SEAQEKLTESNQKLGLLREALERRLGELPADHPKGRLLREELAAASSAAF 300
        |||||||||||||||||||||||||||||||||||||||||||||||||
251 SEAQEKLTESNQKLGLLREALERRLGELPADHPKGRLLREELAAASSAAF 300

301 STRLAGPFPATHYSTLCKPAPLTGTLEVRVVGCRDLPETIPWNPTPSMGG 350
        |||||||||||||||||||||||||||||||||||||||||||||||||
301 STRLAGPFPATHYSTLCKPAPLTGTLEVRVVGCRDLPETIPWNPTPSMGG 350

351 PGTPDSRPPFELSRPARGLYSRSGSLSGRSSLKAEAENTSEVSTVLKLDNT 400
        |||||||||||||||||||||||||||||||||||||||||||||||||
351 PGTPDSRPPFELSRPARGLYSRSGSLSGRSSLKAEAENTSEVSTVLKLDNT 400
```

FIG. 54 (CONT.¹)

```
 25 GGQRLLCATDVPIRTVSSAASQGLHMQNDDACLGAASP  62
     |||||||||||||||||||||||||||||||
403 GEPYLLCATDVPIRTVSSAASQGLHMQNDDACLGAASP 440
```

FIG. 55

```
 90 LSGASPFLGETKQETLTNISAVNYDFDEEYFSNTSELAKDFIRRLLVKDP 139
    ||||||||||||||||||||||||||||||||||||||||||||||||||
211 LSGASPFLGETKQETLTNISAVNYDFDEEYFSNTSELAKDFIRRLLVKDP 260

140 KRRMTIAQSLEHSWIKAIRRRNVRGEDSGRKPERRRLKTTRLKEYTIKSH 189
    ||||||||||||||||||||||||||||||||||||||||||||||||||
261 KRRMTIAQSLEHSWIKAIRRRNVRGEDSGRKPERRRLKTTRLKEYTIKSH 310

190 SSLPPNNSYADFERFSKVLEEAAAAEEGLRELQRSRRLCHEDVEALAAIY 239
    ||||||||||||||||||||||||||||||||||||||||||||||||||
311 SSLPPNNSYADFERFSKVLEEAAAAEEGLRELQRSRRLCHEDVEALAAIY 360

240 EEKEAWYREESDSLGQDLRRLRQELLKTEALKRQAQEEAKGALLGTSGLK 289
    ||||||||||||||||||||||||||||||||||||||||||||||||||
361 EEKEAWYREESDSLGQDLRRLRQELLKTEALKRQAQEEAKGALLGTSGLK 410

290 RRFSRLENRYEALAKQVASEMRFVQDLVRALEQEKLQGVECGLR 333
    |||||||||||||||||||||||||||||||||||||||||||
411 RRFSRLENRYEALAKQVASEMRFVQDLVRALEQEKLQGVECGLR 454
```

FIG. 56

```
 61  GETALHKAACQRNRAVCQLLVDAGASLRKTDSKGKTPQERAQQAGDPDLA  110
     |||||||||||||||||||||||||||||||||||||||||||||||||
995  GETALHKAACQRNRAVCQLLVDAGASLRKTDSKGKTPQERAQQAGDPDLA 1044

111  AYLESRQNYKVIGHEDLETAV  131
      |||||||||||||||||||||
1045  AYLESRQNYKVIGHEDLETAV 1065
```

FIG. 57

```
  1 MRGAARLGRPGRSCLPGPALRAPPRPPLLLLALIPLLPAPGAAAAPAPR    50
    ||||||||||||||||||||||||||   |   ||  ||  ||   ||
  1 MRGAARLGRPGRSCLPGPALRAAAAP..ALLLARCAVAAAAGLRAAARPR   48

51 PPELQSASAGPSVSLYLSEDEVRRLIGLDAELYYVRNDLISHYALSFSLL  100
    |||||||||||||||||||||||||||||||||||||||||||||:||
 49 PPELQSASAGPSVSLYLSEDEVRRLIGLDAELYYVRNDLISHYALSFNLL   98

101 VPSETNFLHFTWHAKSKVEYKLGFQVDNVLAMDMPQVNISVQGEVPRTLS  150
    |||||||||||||||||||||||||||||||||||||||||||||||||
 99 VPSETNFLHFTWHAKSKVEYKLGFQVDNVLAMDMPQVNISVQGEVPRTLS  148

151 VFRVELSCTGKVDSEVMILMQLNLTVNSSKNFTVLNFKRRKMCYKKLEEV  200
    |||||||||||||||||||||||||||||||||||||||||||||||||
149 VFRVELSCTGKVDSEVMILMQLNLTVNSSKNFTVLNFKRRKMCYKKLEEV  198

201 KTSALDKNTSRTIYDPVHAAPTTSTRVFYISVGVCCAVIFLVAIILAVLH  250
    |||||||||||||||||||||||||||||||||||||||||||||||||
199 KTSALDKNTSRTIYDPVHAAPTTSTRVFYISVGVCCAVIFLVAIILAVLH  248

251 LHSMKRIELDD  261
    ||:||||||||
249 LHNMKRIELDD  259
```

FIG. 58

```
  1 MPQVNISVQGEVPRTLSVFRVELSCTGKVDSEVMILMQLNLTVNSSKNFT   50
    |||||||||||||||||||||||||||||||||||||||||||||||||
132 MPQVNISVQGEVPRTLSVFRVELSCTGKVDSEVMILMQLNLTVNSSKNFT  181

51 VLNFKRRKMCYKKLEEVKTSALDKNTSRTIYDPVHAAPTTSTRVFYISVG  100
    |||||||||||||||||||||||||||||||||||||||||||||||||
182 VLNFKRRKMCYKKLEEVKTSALDKNTSRTIYDPVHAAPTTSTRVFYISVG  231

101 VCCAVIFLVAIILAVLHLHSMKRIELDDSISASSSSQGLSQPSTQTTQYL  150
    |||||||||||||||||||:|||||||||||||||||||||||||||||
232 VCCAVIFLVAIILAVLHLHNMKRIELDDSISASSSSQGLSQPSTQTTQYL  281

151 RADTPNNATPITSSYYPTLRIEKNDLRSVTLLEAKGKVKDIAISRERITL  200
    ||||||||||||||  |||||||||||||||||||||||||||||||||
282 RADTPNNATPITS..YPTLRIEKNDLRSVTLLEAKGKVKDIAISRERITL  329

201 KDVLQEGTFGRIFHGILIDEKDPNKEKQAFVKTVKDQASEIQVTMMLTES  250
    |||||||||||||||||||||||||||||||||||||||||||||||||
330 KDVLQEGTFGRIFHGILIDEKDPNKEKQAFVKTVKDQASEIQVTMMLTES  379
```

FIG. 59

```
251 CKLRGLHHRNLLPITHVCIEEGEKPMVILPYMNWGNLKLFLRQCKLVEAN 300
    |||||||||||||||||||||||||||||||||||||||||||||||||
380 CKLRGLHHRNLLPITHVCIEEGEKPMVILPYMNWGNLKLFLRQCKLVEAN 429

301 NPQAISQQDLVHMAIQIACGMSYLARREVIHKDLAARNCV 340
    |||||||||||||||||||||||||||||||||||||||
430 NPQAISQQDLVHMAIQIACGMSYLARREVIHKDLAARNCV 469
```

FIG. 59 (CONT.¹)

```
  1 MEAIRTDNQNFASQLREAEAARNRDLEAHVRQLQERMELLQAEGATAVTGV 50
    ||||||||||||||||||||||||||||||||||||||||||||||||||
484 MEAIRTDNQNFASQLREAEAARNRDLEAHVRQLQERMELLQAEGATAVTGV 533

51 PSPRATDPPSHL..................DGPPAVAVGQCPLVGP.GPMHRRHL 86
    ||||||||||||                   |::|:  |  | || |   ::||
534 PSPRATDPPSHMAPRPWLWASARWWGQAPCTAATCCSLPGSLGLAYRR.. 581

87 LLPARVP...RPGLSEALSLLLFAVVLSRAAALGCIGLVAHAGQLTAVWR 133
    ||:|  |    | |  |   |   |||             |:::   |
582 .....RFPCSCSP..............LFCLVPPPWAALGWWPTPANSPQ...... 612

134 RPGAARAP 141
    |||  | |
613 .SGAAQEP  619
```

FIG. 60

```
  1 MELLQAEGATAVTGVPSPRATDPPSHL............DGPPAVAVGQ  37
    ||||||||||||||||||||||||||              |::|:
519 MELLQAEGATAVTGVPSPRATDPPSHMAPRPWLWASARWWGQAPCTAATC 568

38 CPLVGP.GPMHRRHLLLPARVP...RPGLSEALSLLLFAVVLSRAAALGC  83
    |:: | | ||               ||:: |    ||||
569 CSLPGSLGLAYRR......RFPCSCSP........LFCLVPPWAALGW 603

84 IGLVAHAGQLTAVWRRPGAAARAP 106
    |:: |       |||| |
604 WPTPANSPQ.........SGAAQEP 619
```

FIG. 61

```
  6 HEDEEFISGTRMRKLAREGQKPPEGFMAPKAWTVLTEYYKSLEKA  50
    ||||||| |||||||||||||||||||||||||||||||||||||
580 HEDEEFILGTRMRKLAREGQKPPEGFMAPKAWTVLTEYYKSLEKA 624
```

FIG. 62

```
  1  MARTTSQLYDAVPIQSSVVLCSCPSPSMVRTQTESSTPPGIPGGSRQGPA   50
     |||||||||||||||||||||||||||||||||||||||||||||||||||
  1  MARTTSQLYDAVPIQSSVVLCSCPSPSMVRTQTESSTPPGIPGGSRQGPA   50

51  MDGTAAEPRPGAGSLQHAQPPPQPRKKRPEDFKFGKILGEGSFSTVVLAR  100
     |||||||||||||||||||||||||||||||||||||||||||||||||||
 51  MDGTAAEPRPGAGSLQHAQPPPQPRKKRPEDFKFGKILGEGSFSTVVLAR  100

101  ELATSREYAIKILEKRHIIKENKVPYVTRERDVMSRLDHPFFVKLYFTFQ  150
     |||||||||||||||||||||||||||||||||||||||||||||||||||
101  ELATSREYAIKILEKRHIIKENKVPYVTRERDVMSRLDHPFFVKLYFTFQ  150

151  DDEKLYFGLSYAKNGELLKYIRKIGSFDETCTRFYTAEIVSALEYLHGKG  200
     |||||||||||||||||||||||||||||||||||||||||||||||||||
151  DDEKLYFGLSYAKNGELLKYIRKIGSFDETCTRFYTAEIVSALEYLHGKG  200

201  IIHRDLKPENILLNEDMHIQITDFGTAKVLSPESKQ  236
     |||||||||||||||||||||||||||||||||||
201  IIHRDLKPENILLNEDMHIQITDFGTAKVLSPESKQ  236
```

FIG. 63

```
  1 MSDVTIVKEGWVQKRGEYIKNWRPRYFELLKTDGSFIGYKEKPQDVDLPYP 50
    ||||||||||||||||||||||||||||||||||||||||||||||||||
  1 MSDVTIVKEGWVQKRGEYIKNWRPRYFELLKTDGSFIGYKEKPQDVDLPYP 50

51 LNNFSVASSVMFR 63
    ||||||||: :::
 51 LNNFSVAKCQLMK 63
```

FIG. 64

```
  1 MSDVTIVKEGWVQKRGEYIKNWRPRYFLLKTDGSFIGYKEKPQDVDLPYP  50
    ||||||||||||||||||||||||||||||||||||||||||||||||||
  1 MSDVTIVKEGWVQKRGEYIKNWRPRYFLLKTDGSFIGYKEKPQDVDLPYP  50

51 LNNFSVAKCQLMKTERPKPNTFIIRCLQWTTVIERTFHVDTPEEREEWTE 100
    ||||||||||||||||||||||||||||||||||||||||||||||||||
 51 LNNFSVAKCQLMKTERPKPNTFIIRCLQWTTVIERTFHVDTPEEREEWTE 100

101 AIQAVADRLQRQEEERMNCSPTSQIDNIGEEEMDASTTHHKRKTMNDFDY 150
    ||||||||||||||||||||||||||||||||||||||||||||||||||
101 AIQAVADRLQRQEEERMNCSPTSQIDNIGEEEMDASTTHHKRKTMNDFDY 150

151 LKLLGKGTFGKVILVREKASGKYYAMKILKKEVIIAK 187
    ||||||||||||||||||||||||||||||||||||
151 LKLLGKGTFGKVILVREKASGKYYAMKILKKEVIIAK 187
```

FIG. 65

```
 73  SSQYGDERCFMFVLISPTKSVIITILSLLFTLQLFFHLSRERVFSEDRTR  122
     |  |  |: ||::  ::                 ::||||||||||||||||
214  SFQTKDRLCFVMEYVNGG..............ELFFHLSRERVFSEDRTR  249

123  FYGAEIVSALDYLHSGKIVYRDLKLENLMLDKDGHIKITDFGLCKEGITD  172
     |||||||||||||||||||||||||||||||||||||||||||||||||
250  FYGAEIVSALDYLHSGKIVYRDLKLENLMLDKDGHIKITDFGLCKEGITD  299

173  AATMKTFCGTPEYLAPEVLEDNDYGRAVDWWGLGVVMYEMMCGRLPFYNQ  222
     |||||||||||||||||||||||||||||||||||||||||||||||||
300  AATMKTFCGTPEYLAPEVLEDNDYGRAVDWWGLGVVMYEMMCGRLPFYNQ  349

223  DHEKLFELILMEDIKFPRTLSSDAKSLLSGLLIKDPNKRLGGGPDDAKEI  272
     |||||||||||||||||||||||||||||||||||||||||||||||||
350  DHEKLFELILMEDIKFPRTLSSDAKSLLSGLLIKDPNKRLGGGPDDAKEI  399

273  MRHSFFSGVNWQDVYDKKLVPPFKPQVTSETDTRYFDEEFTAQTITITPP  322
     |||||||||||||||||||||||||||||||||||||||||||||||||
400  MRHSFFSGVNWQDVYDKKLVPPFKPQVTSETDTRYFDEEFTAQTITITPP  449

323  EKYDEDGMDCMDNERRPHFPQFSYSASGRE  352
     |||||||||||||||||||||||||||||
450  EKYDEDGMDCMDNERRPHFPQFSYSASGRE  479
```

FIG. 66

```
  1 MELLRTITYQPAASTKMCEQALGKGCGGNSKKKRPPQPPEESQPPQSQAQ  50
    ||||||||||||||||||||||||||||:|||||||||||||||||||||
  1 MELLRTITYQPAASTKMCEQALGKGCGGDSKKKRPPQPPEESQPPQSQAQ  50

51 VPPAAPHHHHHHSHSGPEISRIIVDPTTGKRYCRGKVLGKGGFAKCYEMT 100
    |||||||||||||||||||||||||||||||||||||||||||||||||
 51 VPPAAPHHHHHHSHSGPEISRIIVDPTTGKRYCRGKVLGKGGFAKCYEMT 100

101 DLTNNKVYAAKIIPHSRVAKPHQREKVCMTLE 132
    ||||||||||||||||||||||||||||:|:|
101 DLTNNKVYAAKIIPHSRVAKPHQREKIDKEIE 132
```

FIG. 67

```
  1 MELLRTITYQPAASTKMCEQALGKGCGGNSKKKRPPQPPEESQPPQSQAQ  50
    ||||||||||||||||||||||||||||||||:|||||||||||||||||
  1 MELLRTITYQPAASTKMCEQALGKGCGGDSKKKRPPQPPEESQPPQSQAQ  50

51 VPPAAPHHHHHSHSGPEISRIIVDPTTGKRYCRGKVLGKGGFAKCYEMT  100
    ||||||||||||||||||||||||||||||||||||||||||||||||
 51 VPPAAPHHHHHSHSGPEISRIIVDPTTGKRYCRGKVLGKGGFAKCYEMT  100

101 DLTNNKVYAAKIIPHSRVAKPHQREKIDKEIELHRILHHKHVVQFYHYFE  150
    |||||||||||||||||||||||||||||||||||||||||||||||||
101 DLTNNKVYAAKIIPHSRVAKPHQREKIDKEIELHRILHHKHVVQFYHYFE  150

151 DKENIYILLEYCSRR..VSVNSYLRTFAYPELTWYSKSILSGI        191
    |||||||||||||||   ::  :   ::::  ||:  :|  ::|:||:
151 DKENIYILLEYCSRRSMAHILKARKVLTEPEVRYYLRQIVSGL        193
```

FIG. 68

```
  1  MELLRTITYQPAASTKMCEQALGKGCGGNSKKKRPPQPPEESQPPQSQAQ    50
     |||||||||||||||||||||||||||||||| :|||||||||||||||||
  1  MELLRTITYQPAASTKMCEQALGKGCGGDSKKKRPPQPPEESQPPQSQAQ    50

51  VPPAAPHHHHHSHSGPEISRIIVDPTTGKRYCRGKVLGKGGFAKCYEMT   100
     ||||||||||||||||||||||||||||||||||||||||||||||||
 51  VPPAAPHHHHHSHSGPEISRIIVDPTTGKRYCRGKVLGKGGFAKCYEMT   100

101  DLTNNKVYAAKIIPHSRVAKPHQREKIDKEIELHRILHHKHVVQFYHYFE   150
     |||||||||||||||||||||||||||||||||||||||||||||||||
101  DLTNNKVYAAKIIPHSRVAKPHQREKIDKEIELHRILHHKHVVQFYHYFE   150

151  DKENIYILLEYCSRR   165
     |||||||||||||||
151  DKENIYILLEYCSRR   165
```

FIG. 69

```
  1  MGHALCVCSRGTVIIDNKRYLFIQKLGEGGFSYVDLVEGLHDGHFYALKR  50
     ||||||||||||||||||||||||||||||||||||||||||||||||||
  1  MGHALCVCSRGTVIIDNKRYLFIQKLGEGGFSYVDLVEGLHDGHFYALKR  50

51  ILCHEQQDREEAQREADMHRLFNHPNILRLVAYCLRERGAKHEAWLLLPF  100
     ||||||||||||||||||||||||||||||||||||||||||||||||||
 51  ILCHEQQDREEAQREADMHRLFNHPNILRLVAYCLRERGAKHEAWLLLPF  100

```
  1 MERAISPGLLVRALILLLLLGLAARTVAAGRARGLPAPTAEAAFGLGAAA  50
    ||||||||||||||||||||||||||||||||||||||||||||||||||
  1 MERAISPGLLVRALILLLLLGLAARTVAAGRARGLPAPTAEAAFGLGAAA  50

51 APTSATRVPAAGAVAAAEVTVEDAEALPAAAGEQEPRGPEPDDETELRPR 100
    ||||||||||||||||||||||||||||||||||||||||||||||||||
 51 APTSATRVPAAGAVAAAEVTVEDAEALPAAAGEQEPRGPEPDDETELRPR 100

101 GRSLVIISTLDGRIAALDPENHGKKQWDLDVGSGSLVSSSLSKPEVFGNK 150
    ||||||||||||||||||||||||||||||||||||||||||||||||||
101 GRSLVIISTLDGRIAALDPENHGKKQWDLDVGSGSLVSSSLSKPEVFGNK 150

151 MIIPSLDGALFQWDRDRESMETVPFTVESLLESSYKFGDDVVLVGGKSLT 200
    ||||||||||||||||||||||||||||||||||||||||||||||||||
151 MIIPSLDGALFQWDRDRESMETVPFTVESLLESSYKFGDDVVLVGGKSLT 200
```

FIG. 71

201 TYGLSAYSGKVRYICSALGCRQWDSDEMEQEEDILLLQRTQKTVRAVGPR 250
    ||||||||||||||||||||||||||||||||||||||||||||||||||
201 TYGLSAYSGKVRYICSALGCRQWDSDEMEQEEDILLLQRTQKTVRAVGPR 250

251 SGNEKWNFSVGHFELRYIPDMETRAGFIESTFKPNENTEESKIISDVEEQ 300
    ||||||||||||||||||||||||||||||||||||||||||||||||||
251 SGNEKWNFSVGHFELRYIPDMETRAGFIESTFKPNENTEESKIISDVEEQ 300

301 EAAIMDIVIKVSVADWKVMAFSKKGGHLEWEYQFCTPIASAWLLKDGKVI 350
    ||||||||||||||||||||||||||||||||||||||||||||||||||
301 EAAIMDIVIKVSVADWKVMAFSKKGGHLEWEYQFCTPIASAWLLKDGKVI 350

351 PISLFDDTSYTSNDDVLEDEEDIVEAARGATENSVYLGMYRGQLYLQSSV 400
    ||||||||||||||||||||||||||||||||||||||||||||||||||
351 PISLFDDTSYTSNDDVLEDEEDIVEAARGATENSVYLGMYRGQLYLQSSV 400

401 RISEKFPSSPKALESVTNENAIIPLPTIKWKPLIHSPSRTPVLVGSDEFD 450
    ||||||||||||||||||||||||||||||||||||||||||||||||||
401 RISEKFPSSPKALESVTNENAIIPLPTIKWKPLIHSPSRTPVLVGSDEFD 450

FIG. 71 (CONT.¹)

```
451 KCLSNDKFSHEEYSNGALSILQYPYDNGYYLPYYKRERNKRSTQITVRFL 500
    |||||||||||||||||||||||||||||||||||||||||||||||||
451 KCLSNDKFSHEEYSNGALSILQYPYDNGYYLPYYKRERNKRSTQITVRFL 500

501 DNPHYNKNIRKKDPVLLLHWWKEIVATILFCIIATTFIVRRLFHPHPHRQ 550
    |||||||||||||||||||||||||||||||||||||||||||||||||
501 DNPHYNKNIRKKDPVLLLHWWKEIVATILFCIIATTFIVRRLFHPHPHRQ 550

551 RKESETQCQTENKYDSVSGEANDSSWNDIKNSGYISRYLTDFEPIQCLGR 600
    |||||||||||||||||||||||||||||||||||||||||||||||||
551 RKESETQCQTENKYDSVSGEANDSSWNDIKNSGYISRYLTDFEPIQCLGR 600

601 GGFGVVFEAKNKVDDCNYAIKRIRLPNRELAREKVMREVKALAKLEHPGI 650
    |||||||||||||||||||||||||||||||||||||||||||||||||
601 GGFGVVFEAKNKVDDCNYAIKRIRLPNRELAREKVMREVKALAKLEHPGI 650

651 VRYFNAWLEAPPEKWQEKMDEIWLKDESTDWPLSSPSPMDAPSVKIRRMD 700
    |||||||||||||||||||||||||||||||||||||||||||||||||
651 VRYFNAWLEAPPEKWQEKMDEIWLKDESTDWPLSSPSPMDAPSVKIRRMD 700
```

FIG. 71(CONT.²)

```
701  PFSTKEHIEIIAPSPQRSRSFSVGISCDQTSSSESQFSPLEFSGMDHEDI  750
     ||||||||||||||||||||||||||||||||||||||||||||||||||
701  PFSTKEHIEIIAPSPQRSRSFSVGISCDQTSSSESQFSPLEFSGMDHEDI  750

751  SESVDAAYNLQDSCLTDCDVEDGTMDGNDEGHSFELCPSEASPYVRSRER  800
     ||||||||||||||||||||||||||||||||||||||||||||||||||
751  SESVDAAYNLQDSCLTDCDVEDGTMDGNDEGHSFELCPSEASPYVRSRER  800

801  TSSSIVFEDSGCDNASSKEEPKTNRLHIGNHCANKLT  837
     ||||||||||||||||||||||||||||||||||||
801  TSSSIVFEDSGCDNASSKEEPKTNRLHIGNHCANKLT  837
```

FIG. 71 (CONT.³)

```
  1 MGSRAQKSAGNAELWEPLPEGRPRPAGTSSAVSAWASLKLCLRGGSGRRQ  50
    ||||||||||||||||||||||||||||||||||||||||||||||||||
  1 MGSRAQKSAGNAELWEPLPEGRPRPAGTSSAVSAWASLKLCLRGGSGRRQ  50

51 RLGGGRMQPEEGHRLAAGAAVRGAAATVLLRLRDDLNVTRLSHFEYVKNE 100
    ||||||||||||||||||||||||||||||||||||||||||||||||||
 51 RLGGGRMQPEEGHRLAAGAAVRGAAATVLLRLRDDLNVTRLSHFEYVKNE 100

101 DLEKIGMGRPGQRRLWEAVKRRKALCKRKSWMNKVFSGKRLEAEFPPHHS 150
    |||||||||||||||||||||||||||||||||:|||||||||||||||
101 DLEKIGMGRPGQRRLWEAVKRRKALCKRKSWMSKVFSGKRLEAEFPPHHS 150

151 QSTFRKTSPAPGGPAGEGPLQSLTCLIGEKDLRLLEKLGDGSFGVVRRGE 200
    ||||||||||||||||||||||||||||||||||||||||||||||||||
151 QSTFRKTSPAPGGPAGEGPLQSLTCLIGEKDLRLLEKLGDGSFGVVRRGE 200

201 WDAPSGKTVS.......................................  210
    ||||||||||
201 WDAPSGKTVSVAVKCLKPDVLSQPEAMDDFIREVNAMHSLDHRNLIRLYG 250
```

FIG. 72

```
210 .......................................................... 210
251 VVLTPPMKMVTELAPLGSLLDRLRKHQGHFLLGTLSRYAVQVAEGMGYLE          300
210 .......................................................... 210
301 SKRFIHRDLAARNLLLATRDLVKIGDFGLMRALPQNDDHYVMQEHRKVPF          350
210 .......................................................... 210
351 AWCAPESLKTRTFSHASDTWMFGVTLWEMFTYGQEPWIGLNGSQILHKID          400
210 .......................................................... 210
401 KEGERLPRPEDCPQDIYNVMVQCWAHKPEDRPTFVALRDFLLEAQPTDMR          450
```

FIG. 72 (CONT.¹)

```
210 ......................................................... 210
451 ALQDFEEPDKLHIQMNDVITVIEGRAENYWWRGQNTRTLCVGPFPRNVVT 500
210 ......................................................... 210
501 SVAGLSAQDISQPLQNSFIHTGHGDSDPRHCWGFPDRIDELYLGNPMDPP 550
211 ............PPQPAFFTQKPTYDPVSEDQDPLSSDFKRLGLRKPGLPR 249
             :::       ||||||||||||||||||||||||||||||
551 DLLSVELSTSRPPPQHLGGVKKPTYDPVSEDQDPLSSDFKRLGLRKPGLPR 600
250 GLWLAKPSARVPGTKASRGSGAEVTLIDFGEEPVVPALRPCAPSLAQLAM 299
    ||||||||||||||||||||||||||||||||||| ::: 
601 GLWLAKPSARVPGTKASRGSGAEVTLIDFGEEPVVP...PYGPAALPGAA 647
300 DACSLL..DETPPQSPTRALPRPLHPTPVVDWDARPLPPPPAYDDVAQDE 347
    ::  :::   |   ||||||||||||||||||||||||||||||
648 GHGRLLPAGRDPASEPHAGTARPLHPTPVVDWDARPLPPPPAYDDVAQDE 697
```

FIG. 72 (CONT.²)

```
348 DDFEICSINSTLVGAGVPAGPSQGQTNYAFVPEQARPPPPLEDNLFLPPQ 397
    |||||||||||||||||||||||||||||||||||||||||||||||||
698 DDFEICSINSTLVGAGVPAGPSQGQTNYAFVPEQARPPPPLEDNLFLPPQ 747

398 GGGKPPSSAQTAEIFQALQQECMRQLQAPAGSPAPSPGGDDKPQVPPR   447
    ||||||||||||||||||||||||||||||| ||||||||||||||||
748 GGGKPPSSAQTAEIFQALQQECMRQLQAP.GSPAPSPGGDDKPQVPPR   796

448 VPIPPRPTRPHVQLSPAPPGEEETSQWPGPASPPRVPPREPLSPQGSRTP 497
    |||||||||||||||||||||||||||||||||||||||||||||||||
797 VPIPPRPTRPHVQLSPAPPGEEETSQWPGPASPPRVPPREPLSPQGSRTP 846

498 SPLVPPGSSPLPPRLSSSPGKTMPTTQSFASDPKYATPQVIQAPGPRAGP 547
    ||||||||||||||||||||||||||||||||||||||||||||| :||
847 SPLVPPGSSPLPPRLSSSPGKTMPTTQSFASDPKYATPQVIQAPG.AGGP 895

548 CILPIVRDGKKVSSTHYYLLPERPSYLERYQRFLREAQSPEEPTPLPVPL 597
    |||||||||||||||||||||||||||||||||||||||||||||||||
896 CILPIVRDGKKVSSTHYYLLPERPSYLERYQRFLREAQSPEEPTPLPVPL 945
```

FIG. 72 (CONT.³)

```
598  LLPPPSTPAPAAPTATVRPMPQAALDPKANFSTNNSNPGARPPPPRATAR   647
     ||||||||||||||||||||||||||||||||||||||||||||||||||
946  LLPPPSTPAPAAPTATVRPMPQAALDPKANFSTNNSNPGARPPPPRATAR   995

648  LPQRGCPGDGPEAGRPADKIQMAMVHGVTTEECQAALQCHGWSVQRACPV   697
     ||||||||||||||||||||||||||||||||||||||||||||||||||
996  LPQRGCPGDGPEAGRPADKIQMAMVHGVTTEECQAALQCHGWSVQRACPV   1045

698  SEGGAALRAGSAAQRECHKVLEMFDWNLEQAGCHLLGSWGPAHHKR   743
     |||||||||||||||||||||||||||||||||||||||||||||
1046 SEGGAALRAGSAAQRECHKVLEMFDWNLEQAGCHLLGSWGPAHHKR   1091
```

FIG. 72 (CONT.⁴)

```
  1 MASNPERGEILLTELQGDSRSLPFSENVSAVQKLDFSDTMVQQKLDDIKD  50
    ||||||||||||||||||||||||||||||||||||||||||||||||||
  1 MASNPERGEILLTELQGDSRSLPFSENVSAVQKLDFSDTMVQQKLDDIKD  50

51 RIKREIRKELKIKEGAENLRKVTTDKKSLAYVDNILKKSNKKLEELHHKL 100
    ||||||||||||||||||||||||||||||||||||||||||||||||||
 51 RIKREIRKELKIKEGAENLRKVTTDKKSLAYVDNILKKSNKKLEELHHKL 100

101 QELNAHIVVSDPEDITDCPRTPDTPNNDPRCSTSNNRLKALQKQLDIELK 150
    ||||||||||||||||||||||||||||||||||||||||||||||||||
101 QELNAHIVVSDPEDITDCPRTPDTPNNDPRCSTSNNRLKALQKQLDIELK 150

151 VKQGAENMIQMYSNGSSKDRKLHGTAQQLLQDSKTKIEVIRMQILQAVQT 200
    ||||||||||||||||||||||||||||||||||||||||||||||||||
151 VKQGAENMIQMYSNGSSKDRKLHGTAQQLLQDSKTKIEVIRMQILQAVQT 200

201 NELAFDNAKPVISPLELRMEELRHHFRIEFAVAEGAKNVMKLLGSGKVTD 250
    ||||||||||||||||||||||||||||||||||||||||||||||||||
201 NELAFDNAKPVISPLELRMEELRHHFRIEFAVAEGAKNVMKLLGSGKVTD 250

251 RKALSEAQARFNESSQKLDLLKYSLEQRLNEVPKNHPKSRIIEELSLVA  300
    ||||||||||||||||||||||||||||||||||||||||||||||||
251 RKALSEAQARFNESSQKLDLLKYSLEQRLNEVPKNHPKSRIIEELSLVA  300
```

FIG. 73

```
301 ASPTLSPRQSMISTQNQYSTLSKPAALTGTLEVRLMGCQDILENVPGRSK 350
    |||||||||||||||||||||||||||||||||||||||||||||||||
301 ASPTLSPRQSMISTQNQYSTLSKPAALTGTLEVRLMGCQDILENVPGRSK 350

351 ATSVALPGWSPSETRSSFMSRTSKSKSGSSRNLLKTDDLSNDVCAVLKLD 400
    |||||||||||||||||||||||||||||||||||||||||||||||||
351 ATSVALPGWSPSETRSSFMSRTSKSKSGSSRNLLKTDDLSNDVCAVLKLD 400

401 NTVVGQTSWKPISNQSWDQKFTLELDRSRELEISVYWRDWRSLCAVKFLR 450
    |||||||||||||||||||||||||||||||||||||||||||||||||
401 NTVVGQTSWKPISNQSWDQKFTLELDRSRELEISVYWRDWRSLCAVKFLR 450

451 LEDFLDNQRHGMCLYLEPQGTLFAEVTFFNPVIERRPKLQRQKKIFSKQQ 500
    |||||||||||||||||||||||||||||||||||||||||||||||||
451 LEDFLDNQRHGMCLYLEPQGTLFAEVTFFNPVIERRPKLQRQKKIFSKQQ 500

501 GKTFLRAPQMNINIATWGRLVRRAIPTVNHSGTFSPQAPVPTTVPVVDVR 550
    |||||||||||||||||||||||||||||||||||||||||||||||||
501 GKTFLRAPQMNINIATWGRLVRRAIPTVNHSGTFSPQAPVPTTVPVVDVR 550

551 IPQLAPPA 558
    ||||||||
551 IPQLAPPA 558
```

FIG. 73 (CONT.¹)

```
  1  MASNPERGEILLTELQGDSRSLPFSENVSAVQKLDFSDTMVQQKLDDIKD   50
     ||||||||||||||||||||||||||||||||||||||||||||||||||
  1  MASNPERGEILLTELQGDSRSLPFSENVSAVQKLDFSDTMVQQKLDDIKD   50

51  RIKREIRKELKIKEGAENLRKVTTDKKSLAYVDNILKKSNKKLEELHHKL  100
     |||||||||||||||||||||||||||||||||||||||||||||||||
 51  RIKREIRKELKIKEGAENLRKVTTDKKSLAYVDNILKKSNKKLEELHHKL  100

101  QELNAHIVVSDPEDITDCPRTPDTPNNDPRCSTSNNRLKALQKQLDIELK  150
     |||||||||||||||||||||||||||||||||||||||||||||||||
101  QELNAHIVVSDPEDITDCPRTPDTPNNDPRCSTSNNRLKALQKQLDIELK  150

151  VKQGAENMIQMYSNGSSKDRKLHGTAQQLLQDSKTKIEVIRMQILQAVQT  200
     |||||||||||||||||||||||||||||||||||||||||||||||||
151  VKQGAENMIQMYSNGSSKDRKLHGTAQQLLQDSKTKIEVIRMQILQAVQT  200

201  NELAFDNAKPVISPLELRMEELRHHFRIEFAVAEGAKNVMKLLGSGKVTD  250
     |||||||||||||||||||||||||||||||||||||||||||||||||
201  NELAFDNAKPVISPLELRMEELRHHFRIEFAVAEGAKNVMKLLGSGKVTD  250
```

FIG. 74

```
251 RKALSEAQARFNESSQKLDLLKYSLEQRLNEVPKNHPKSRIIIEELSLVA 300
    |||||||||||||||||||||||||||||||||||||||||||||||||
251 RKALSEAQARFNESSQKLDLLKYSLEQRLNEVPKNHPKSRIIIEELSLVA 300

301 ASPTLSPRQSMISTQNQYSTLSKPAALTGTLEVRLMGCQDILENVPGRSK 350
    |||||||||||||||||||||||||||||||||||||||||||||||||
301 ASPTLSPRQSMISTQNQYSTLSKPAALTGTLEVRLMGCQDILENVPGRSK 350

351 ATSVALPGWSPSETRSSFMSRTSKSKSGSSRNLLKTDDLSNDVCAVLKLD 400
    |||||||||||||||||||||||||||||||||||||||||||||||||
351 ATSVALPGWSPSETRSSFMSRTSKSKSGSSRNLLKTDDLSNDVCAVLKLD 400

401 NTVVGQTSWKPISNQSWDQKFTLELDRSRELEISVYWRDWRSLCAVKFLR 450
    |||||||||||||||||||||||||||||||||||||||||||||||||
401 NTVVGQTSWKPISNQSWDQKFTLELDRSRELEISVYWRDWRSLCAVKFLR 450
```

FIG. 74 (CONT.¹)

```
451 LEDFLDNQRHGMCLYLEPQGTLFAEVTFFNPVIERRPKLQRQKKIFSKQQ 500
    |||||||||||||||||||||||||||||||||||||||||||||||||
451 LEDFLDNQRHGMCLYLEPQGTLFAEVTFFNPVIERRPKLQRQKKIFSKQQ 500

501 GKTFLRRAPQMNINIATWGRLVRRAIPTVNHSGTFSPQAPVPTTVPVVDVR 550
    |||||||||||||||||||||||||||||||||||||||||||||||||
501 GKTFLRRAPQMNINIATWGRLVRRAIPTVNHSGTFSPQAPVPTTVPVVDVR 550

551 IPQLAPPASDSTVTKLDEDLEPPPAPPRASSLGEIDESSELRVLDIPG 600
    ||||||||||||||||||||||||||||||||||||||||||||||||
551 IPQLAPPASDSTVTKLDEDLEPPPAPPRASSLGEIDESSELRVLDIPG 600

601 QAS 603
                        |·|
                    601 QDS 603
```

FIG. 74 (CONT.²)

```
  1 MVSSQKLEKPIEMGSSEPLPIADGDRRKKKRRGRATDSLPGKFEDMYKL   50
    ||||||||||||||||||||||||||||||||||||||||||||||||||
  1 MVSSQKLEKPIEMGSSEPLPIADGDRRRKKKRRGRATDSLPGKFEDMYKL   50

51 TSELLGEGAYAKVQGAVSLQNGKEYAVKIIEKQAGHSRSRVFREVETLYQ  100
    ||||||||||||||||||||||||||||||||||||||||||||||||||
 51 TSELLGEGAYAKVQGAVSLQNGKEYAVKIIEKQAGHSRSRVFREVETLYQ  100

101 CQGNKNILELIEFFEDDTRFYLVFEKLQGGT  131
    |||||||||||||||||||||||||||||:
101 CQGNKNILELIEFFEDDTRFYLVFEKLQGGS  131
```

FIG. 75

```
 63 MVSSQKLEKPIEMGSSEPLPIADGDRRKKKRRGRATDSLPGKFEDMYKL 112
    ||||||||||||||||||||||||||||||||||||||||||||||||
  1 MVSSQKLEKPIEMGSSEPLPIADGDRRKKKRRGRATDSLPGKFEDMYKL  50

113 TSELLGEGAYAKVQGAVSLQNGKEYAVKV 141
    |||||||||||||||||||||||||||:
 51 TSELLGEGAYAKVQGAVSLQNGKEYAVKI  79
```

FIG. 76

```
  1 MGSGMKLNNSCTPITTPELTTPCGSAEYMAPEVVEVFTDQATFYDKRCDL  50
    :|||||||||||||||||||||||||||||||||||||||||||||||||
194 LGSGMKLNNSCTPITTPELTTPCGSAEYMAPEVVEVFTDQATFYDKRCDL 243

51 WSLGVVLYIMLSGYPPFVGHCGADCGWDRGEVCRVCQNKLFESIQEGKYE 100
    ||||||||||||||||||||||||||||||||||||||||||||||||||
244 WSLGVVLYIMLSGYPPFVGHCGADCGWDRGEVCRVCQNKLFESIQEGKYE 293

101 FPDKDWAHISSEAKDLISKLLVRDAKQRLSAAQVLQHPWVQGQAPEKGLP 150
    ||||||||||||||||||||||||||||||||||||||||||||||||||
294 FPDKDWAHISSEAKDLISKLLVRDAKQRLSAAQVLQHPWVQGQAPEKGLP 343

151 TPQVLQRNSSTMDLTLFAAEAIALNRQLSQHEENELAEEPEALADGLCSM 200
    ||||||||||||||||||||||||||||||||||||||||||||||||||
344 TPQVLQRNSSTMDLTLFAAEAIALNRQLSQHEENELAEEPEALADGLCSM 393

201 KLSPPPCKSRLARRRALAQAGRGEDRSPPTAL 231
    |||||||||||||||||||||||||||||||
394 KLSPPPCKSRLARRRALAQAGRGEDRSPPTAL 424
```

FIG. 77

```
  1 MRKGVLKDPEIADLFYKDDPEELFIGLHEIGHGSFGAVYFATNAHTSEVV  50
    |||||||||||||||||||||||||||||||||||||||||||||||||
  1 MRKGVLKDPEIADLFYKDDPEELFIGLHEIGHGSFGAVYFATNAHTSEVV  50

51 AIKKMSYSGKQTHEKWQDILKEVKFLRQLKHPNTIEYKGCYLKEHTAWLV 100
    |||||||||||||||||||||||||||||||||||||||||||||||||
 51 AIKKMSYSGKQTHEKWQDILKEVKFLRQLKHPNTIEYKGCYLKEHTAWLV 100

101 MEYCLGSASDLLEVHKKPLQEVEIAAITHGALHGLAYLHSHALIHR 146
    |||||||||||||||||||||||||||||||||||||||||||||
101 MEYCLGSASDLLEVHKKPLQEVEIAAITHGALHGLAYLHSHALIHR 146
```

FIG. 78

```
2  MEELHSLDPRRQELLEARFTGVGVSKGPLNSESSNQSLCSVGSLSDKEVE  51
   |||||||||||||||||||||||||||||||||||||||||||||||||
1  MEELHSLDPRRQELLEARFTGVGVSKGPLNSESSNQSLCSVGSLSDKEVE  50

52 TPEKKQNDQRNRKRKAEPYETSQGKGTPRGHKISDYFETA  91
   |||||||||||||||||||||||||||||||||||||| 
51 TPEKKQNDQRNRKRKAEPYETSQGKGTPRGHKISDYFEFA  90
```

FIG. 79

```
 27  KDLVEEEAEEAGVALRSTQSTLQAGLAADAWAAPIAMQIYKKHLDPRPGP   76
     ||||||||||||||||||||||||||||||||||||||||||||||||||
435  KDLVEEEAEEAGVALRSTQSTLQAGLAADAWAAPIAMQIYKKHLDPRPGP  484

77  CHLSWAWAWASWPAAACTAGPKGRPPMTQVYERLEKLQAVVAGVPGHLEA  126
      ::  :   :    :::    ||||||||||||||||||||||||||||
485  CPPELGLGLGQLACCCLHRRAKRPPMTQVYERLEKLQAVVAGVPGHLEA  534

127  ASCI.PFPQENSYVSSTGRAHSGAAPWQPLAAPSGASAQAAEQLQRGPNQ  175
     |||| |  :  ||||||||||||||||||||||||||||||||||||||
535  ASCIPPSPQENSYVSSTGRAHSGAAPWQPLAAPSGASAQAAEQLQRGPNQ  584

176  PVESDESLGGLSAALRSWHLTPSCPLDPAPLREAGCPQGDTAGESSWGSG  225
     ||||||||||||||||||||||||||||||||||||||||||||||||||
585  PVESDESLGGLSAALRSWHLTPSCPLDPAPLREAGCPQGDTAGESSWGSG  634

226  PGSRPTAVEGLALGSSASSSSEPPQIIINPARQKMVQKLALYEDGALDSL  275
     ||||||||||||||||||||||||||||||||||||||||||||||||||
635  PGSRPTAVEGLALGSSASSSSEPPQIIINPARQKMVQKLALYEDGALDSL  684

276  QLISSSSLPGLGLEQDRQGPKKVMNFRA  303
     ||||||||||||||||||  ::   :|::
685  QLISSSSLPGLGLEQDRQGPEESDEFQS  712
```

FIG. 80

```
 20  QTQACPPLSWPQRLDILLGTARAIQFLHQDSPSLIHGDIKSSNVLLDERL   69
     ||||||||||||||||||||||||||||||||||||||||||||||||||
303  QTQACPPLSWPQRLDILLGTARAIQFLHQDSPSLIHGDIKSSNVLLDERL  352

70  TPKLGDFGLARFSRFAGSSPSQSSMVARTQTVRGTLAYLPEEYIKTGRLA  119
     ||||||||||||||||||||||||||||||||||||||||||||||||||
353  TPKLGDFGLARFSRFAGSSPSQSSMVARTQTVRGTLAYLPEEYIKTGRLA  402

120  VDTDTFSFGVVVLETLAGQRAVKTHGARTKYLKDLVEEEAEEAGVALRST  169
     ||||||||||||||||||||||||||||||||||||||||||||||||||
403  VDTDTFSFGVVVLETLAGQRAVKTHGARTKYLKDLVEEEAEEAGVALRST  452

170  QSTLQAGLAADAWAAPIAMQIYKKHLDPRPGPCHLSWAWAWASWPAAACT  219
     ||||||||||||||||||||||||||||||||  :  ::  ::  :::
453  QSTLQAGLAADAWAAPIAMQIYKKHLDPRPGPCPPELGLGLQLACCCLH   502

220  AGPKGRPPMTQVYERLEKLQAVVAGVPGHLEAASCI.PFPQENSYVSSTG  268
      |  ||||||||||||||||||||||||||||||||  |||||||||||
503  RRAKRRPPMTQVYERLEKLQAVVAGVPGHLEAASCIPPSPQENSYVSSTG  552
```

FIG. 81

```
269 RAHSGAAPWQPLAAPSGASAQAAEQLQRGPNQPVESDESLGGLSAALRSW 318
    ||||||||||||||||||||||||||||||||||||||||||||||||||
553 RAHSGAAPWQPLAAPSGASAQAAEQLQRGPNQPVESDESLGGLSAALRSW 602

319 HLTPSCPLDPAPLREAGCPQGDTAGESSWGSGPGSRPTAVEGLALGSSAS 368
    ||||||||||||||||||||||||||||||||||||||||||||||||||
603 HLTPSCPLDPAPLREAGCPQGDTAGESSWGSGPGSRPTAVEGLALGSSAS 652

369 SSSEPPQIIINPARQKMVQKLALYEDGALDSLQLLSSSSLPGLGLEQDRQ 418
    ||||||||||||||||||||||||||||||||||||||||||||||||||
653 SSSEPPQIIINPARQKMVQKLALYEDGALDSLQLLSSSSLPGLGLEQDRQ 702

419 GPKKVMNFRA 428
    ||:: :|::
703 GPEESDEFQS 712
```

FIG. 81 (CONT.¹)

```
  1 MAGGPGEPAAPGAQHFLYEVPPWVMCRFYKVMDALEPADWCQFAALIV    50
    ||||||||||||||||||||||||||||||||||||||||||||||||
  1 MAGGPGEPAAPGAQHFLYEVPPWVMCRFYKVMDALEPADWCQFAALIV    50

51 RDQTELRLCERSGQRTASVLWPWINRNARVADLVHILTHLQLLRARDIIT  100
    |||||||||||||||||||||||||||||||||||||||||||||||||
 51 RDQTELRLCERSGQRTASVLWPWINRNARVADLVHILTHLQLLRARDIIT  100

101 AWHPPAPLPSPGTTAPRPSSIPAPAEAEAWSPRKLPSSASTELSPAFPGS  150
    |||||||||||||||||||||||||||||||||||||||||||||||||
101 AWHPPAPLPSPGTTAPRPSSIPAPAEAEAWSPRKLPSSASTELSPAFPGS  150

151 QTHSGPELGLVPSPASLWPPPPSPAPSSTKPGPESSVSLLQGARPSPFCW  200
    |||||||||||||||||||||||||||||||||||||||||||||||||
151 QTHSGPELGLVPSPASLWPPPPSPAPSSTKPGPESSVSLLQGARPSPFCW  200
```

FIG. 82

```
201 PLCEISRGTHNFSEELKIGEGGFGCVYRAVMRNTVYAVKRLKENADLEWT 250
    |||||||||||||||||||||||||||||||||||||||||||||||||
201 PLCEISRGTHNFSEELKIGEGGFGCVYRAVMRNTVYAVKRLKENADLEWT 250

251 AVKQSFLTEVEQLSRFRHPNIVDFAGYCAQNGFYCLVYGFLPNGSLEDRL 300
    |||||||||||||||||||||||||||||||||||||||||||||||||
251 AVKQSFLTEVEQLSRFRHPNIVDFAGYCAQNGFYCLVYGFLPNGSLEDRL 300

301 HCQTQACPPLSWPQRLDILLGTARASQVSCNRVSSCVSKSSPGL 344
    ||||||||||||||||||||||||||||  ::||:|
301 HCQTQACPPLSWPQRLDILLGTARAIQF.........LHQDSPSL 336
```

FIG. 82 (CONT.$^1$)

```
  1 MFTEEDVKFYLAELALALDHLHSLGIIYRDLKPENILLDEEGHIKLTDFG   50
    ||||||||||||||||||||||||||||||||||||||||||||||||||
164 MFTEEDVKFYLAELALALDHLHSLGIIYRDLKPENILLDEEGHIKLTDFG  213

51 LSKESIDHEKKAYSFCGTVEYMAPEVVNRRGHTQSADWWSFGVLMFEMLT  100
    ||||||||||||||||||||||||||||||||||||||||||||||||||
214 LSKESIDHEKKAYSFCGTVEYMAPEVVNRRGHTQSADWWSFGVLMFEMLT  263

101 GTLPFQGKDRKETMTMILKAKLGMPQFLSPEAQSLLRMLFKRNPANRLGA  150
    ||||||||||||||||||||||||||||||||||||||||||||||||||
264 GTLPFQGKDRKETMTMILKAKLGMPQFLSPEAQSLLRMLFKRNPANRLGA  313

151 GPDGVEEIKRHSFFSTIDWNKLYRREIHPPFKPATGRPEDTFYFDPEFTA  200
    ||||||||||||||||||||||||||||||||||||||||||||||||||
314 GPDGVEEIKRHSFFSTIDWNKLYRREIHPPFKPATGRPEDTFYFDPEFTA  363

201 KTPKDSPGIPPSANAHQLFRGFSFVAITSDDESQAMQTVGVHSIVQQLHR  250
    ||||||||||||||||||||||||||||||||||||||||||||||||||
364 KTPKDSPGIPPSANAHQLFRGFSFVAITSDDESQAMQTVGVHSIVQQLHR  413

251 NSIQFTDGYEVKEDIGVGSYSVCKRCIHKATNMEFAVKV  289
    ||||||||||||||||||||||||||||||||||||||:
414 NSIQFTDGYEVKEDIGVGSYSVCKRCIHKATNMEFAVKI  452
```

FIG. 83

```
  1 MPLAQLADPWQKMAVESPSDSAENGQQIMDEPMGEEEINPQTEEVSIKEI   50
    ||||||||||||||||||||||||||||||||||||||||||||||||||
  1 MPLAQLADPWQKMAVESPSDSAENGQQIMDEPMGEEEINPQTEEVSIKEI   50

51 AITHHVKEGHEKADPSQFELLKVLGQGSFGKVFLVKKISGSDARQLYAMK  100
    ||||||||||||||||||||||||||||||||||||||||||||||||||
 51 AITHHVKEGHEKADPSQFELLKVLGQGSFGKVFLVKKISGSDARQLYAMK  100

101 VLKKATLKVRDRVRTKMERDILVEVNHPFIVKLHYAFQTEGKLYLILDFL  150
    ||||||||||||||||||||||||||||||||||||||||||||||||||
101 VLKKATLKVRDRVRTKMERDILVEVNHPFIVKLHYAFQTEGKLYLILDFL  150

151 RGGDLFTRLSKEVMFTEEDVKFYLAELALALALDHLHSLGIIYRDLKPE   197
    |||||||||||||||||||||||||||||||||||||||||||||||||
151 RGGDLFTRLSKEVMFTEEDVKFYLAELALALALDHLHSLGIIYRDLKPE   197
```

FIG. 84

```
  1 MSTEADEGITFSVPPFAPSGFCTIPEGGICRRGGAAAVGEGEEHQLPPPP  50
    ||||||||||||||||||||||||||||||||||||||||||||||||||
  1 MSTEADEGITFSVPPFAPSGFCTIPEGGICRRGGAAAVGEGEEHQLPPPP  50

51 PGSFWNVESAAAPGIGCPAATSSSSATRGRGSSVGGGSRRTTVAYVINEA 100
    ||||||||||||||||||||||||||||||||||||||||||||||||||
 51 PGSFWNVESAAAPGIGCPAATSSSSATRGRGSSVGGGSRRTTVAYVINEA 100

101 SQGQLVVAESEALQSLREACETVGATLETLHFGKLDFGETTVLDRFYNAD 150
    ||||||||||||||||||||||||||||||||||||||||||||||||||
101 SQGQLVVAESEALQSLREACETVGATLETLHFGKLDFGETTVLDRFYNAD 150

151 IAVVEMSDAFRQPSLFYHLGVRESFSMANNIILYCDTNSDSLQSLKEIIC 200
    ||||||||||||||||||||||||||||||||||||||||||||||||||
151 IAVVEMSDAFRQPSLFYHLGVRESFSMANNIILYCDTNSDSLQSLKEIIC 200

201 QKNTMCTGNYTFVPYMITPHNKVYCCDSSEMKGLTELMQPNFELLLGPIC 250
    ||||||||||||||||||||||||||||||||||||||||||||||||||
201 QKNTMCTGNYTFVPYMITPHNKVYCCDSSEMKGLTELMQPNFELLLGPIC 250
```

FIG. 85

```
251 LPLVDRFIQLLKVAQASSSQYFRESILNDIRKARNLYTGKELAAELARIR 300
    |||||||||||||||||||||||||||||||||||||||||||||||||
251 LPLVDRFIQLLKVAQASSSQYFRESILNDIRKARNLYTGKELAAELARIR 300

301 QRVDNIEVLTADIVINLLLSYRDIQDYDSIVKLVETLEKLPTFDLASHHH 350
    |||||||||||||||||||||||||||||||||||||||||||||||||
301 QRVDNIEVLTADIVINLLLSYRDIQDYDSIVKLVETLEKLPTFDLASHHH 350

351 VKFHYAFALNRRNLPGDRAKALDIMIPMVQSEGQVASDMYCLVGRIYKDM 400
    |||||||||||||||||||||||||||||||||||||||||||||||||
351 VKFHYAFALNRRNLPGDRAKALDIMIPMVQSEGQVASDMYCLVGRIYKDM 400

401 FLDSNFTDTESRDHGASWFKKAFESEPTLQSGINYAVLLAAGHQFESSF 450
    ||||||||||||||||||||||||||||||||||||||||||||||||
401 FLDSNFTDTESRDHGASWFKKAFESEPTLQSGINYAVLLAAGHQFESSF 450

451 ELRKVG 456
    ||||||
451 ELRKVG 456
```

FIG. 85 (CONT.¹)

```
  1 MREFEVLKKLNHKNIVKLFAIEEETTTRHKVLIMEFCPCGSLYTVLEEPS  50
    ||||||||||||||||||||||||||||||||||||||||||||||||||
 53 MREFEVLKKLNHKNIVKLFAIEEETTTRHKVLIMEFCPCGSLYTVLEEPS 102

51 NAYGLPESEFLIVLRDVVGGMNHLRENGIVHRDIKPGNIMRAL  93
    ||||||||||||||||||||||||||||||||||||||||::
103 NAYGLPESEFLIVLRDVVGGMNHLRENGIVHRDIKPGNIMRVI 145
```

FIG. 86

```
 68  IGS.......AAYDAVLDRNVAIKKLSRPFQNQTHAKRAYRELVLMKCVN  110
         |||      ||||||||||||||||||||||||||||||||||||||||
 70  IGSGAQGIVCAAYDAVLDRNVAIKKLSRPFQNQTHAKRAYRELVLMKCVN  119

111  HKNIISLLNVFTPQKTLEEFQDVYLVMELMDANLCQVIQMELDHERMSYL  160
     |||||||||||||||||||||||||||||||||||||||||||||||||
120  HKNIISLLNVFTPQKTLEEFQDVYLVMELMDANLCQVIQMELDHERMSYL  169

161  LYQMLCGIKHLHSAGIIHRDLKPSNIVVKSDCTLKILDFGLARTAGTSFM  210
     |||||||||||||||||||||||||||||||||||||||||||||||||
170  LYQMLCGIKHLHSAGIIHRDLKPSNIVVKSDCTLKILDFGLARTAGTSFM  219

211  MTPYVVTRYYRAPEVILGMGYKENVDIWSVGCIMGEMVRHKILFPGRDYI  260
     |||||||||||||||||||||||||||||||||||||||||||||||||
220  MTPYVVTRYYRAPEVILGMGYKENVDIWSVGCIMGEMVRHKILFPGRDYI  269

261  DQWNKVIEQLGTPCPEFMKKLQPTVRNYVENRPKYAGLTFPKLFPDSLFP  310
     |||||||||||||||||||||||||||||||||||||||||||||||||
270  DQWNKVIEQLGTPCPEFMKKLQPTVRNYVENRPKYAGLTFPKLFPDSLFP  319
```

FIG. 87

```
311 ADSEHNKLKASQARDLLSKMLVIDPAKRISVDDALQHPYINVWYDPAEVE 360
    |||||||||||||||||||||||||||||||||||||||||||||||||
320 ADSEHNKLKASQARDLLSKMLVIDPAKRISVDDALQHPYINVWYDPAEVE 369

361 APPPQIYDKQLDEREHTIEEWKELIYKEVMNSEEKTKNGVVKGQPSPSAQ 410
    |||||||||||||||||||||||||||||||||||||||||||||||||
370 APPPQIYDKQLDEREHTIEEWKELIYKEVMNSEEKTKNGVVKGQPSPSAQ 419
```

```
411 VQQ 413
    |||
420 VQQ 422
```

FIG. 87 (CONT.¹)

```
  1 MSKSKVDNQFYSVEVGDSTFTVLKRYQNLKPIGSGAQGIVCAAYDAVLDR 50
    ||||||||||||||||||||||||||||||||||||||||||||||||||
 39 MSKSKVDNQFYSVEVGDSTFTVLKRYQNLKPIGSGAQGIVCAAYDAVLDR 88

51 NVAIKKLSRPFQNQTHAKRAYRELVLMKCVNHKNV............... 85
    ||||||||||||||||||||||||||||||||||
 89 NVAIKKLSRPFQNQTHAKRAYRELVLMKCVNHKNIISLLNVFTPQKTLEE 138

86 ....SFVIEKLLAVGVCKI 100
        :::::|: :::|::
139 FQDVYLVMELMDANLCQV 156
```

FIG. 88

```
  1  MAMTGSTPCSSMSNHTKERVTMTKVTLENFYSNLIAQHEEREMRQKKLEK    50
     ||||||||||||||||||||||||||||||||||||||||||||||||||
  1  MAMTGSTPCSSMSNHTKERVTMTKVTLENFYSNLIAQHEEREMRQKKLEK    50

51  VMEEEGLKDEEKRLRRSAHARKETEFLRLKRTRLGLEDFESLKVIGRGAF   100
     ||||||||||||||||||||||||||||||||||||||||||||||||||
 51  VMEEEGLKDEEKRLRRSAHARKETEFLRLKRTRLGLEDFESLKVIGRGAF   100

101  GEVRLVQKKDTGHVYAMKILRKADMLEKEQVGHIRAERDILVEADSLWVV   150
     ||||||||||||||||||||||||||||||||||||||||||||||||||
101  GEVRLVQKKDTGHVYAMKILRKADMLEKEQVGHIRAERDILVEADSLWVV   150

151  KMFYSFQDKLNLYLIMEFLPGGDMMTLLMKKDTLTEEETQFYIAETVLAI   200
     ||||||||||||||||||||||||||||||||||||||||||||||||||
151  KMFYSFQDKLNLYLIMEFLPGGDMMTLLMKKDTLTEEETQFYIAETVLAI   200

201  DSIHQLGFIHRDIKPDNLLLDSKGHVKLSDFGLCTGLKKAHRTEFYRNLN   250
     ||||||||||||||||||||||||||||||||||||||||||||||||||
201  DSIHQLGFIHRDIKPDNLLLDSKGHVKLSDFGLCTGLKKAHRTEFYRNLN   250
```

FIG. 89

```
251 HSLPSDFTFQNMNSKRKAETWKRNRRQLAFSTVGTPDYIAPEVFMQTGYN 300
    |||||||||||||||||||||||||||||||||||||||||||||||||
251 HSLPSDFTFQNMNSKRKAETWKRNRRQLAFSTVGTPDYIAPEVFMQTGYN 300

301 KLCDWWSLGVIMYEMLIG 318
    ||||||||||||||||||
301 KLCDWWSLGVIMYEMLIG 318
```

FIG. 89 (CONT.¹)

```
 11 VSGGSMLDIIKYIVNRGEHKNGVLEEAIIATILKEVLEGLDYLHRNGQIH  60
    :|||||||||||||||||||||||||||||||||||||||||||||||||
143 LSGGSMLDIIKYIVNRGEHKNGVLEEAIIATILKEVLEGLDYLHRNGQIH 192

61 RDLKAGNILLGEDGSVQIADFGVSAFLATGGDVTRNKVRKTFVGTPCWMA 110
    ||||||||||||||||||||||||||||||||||||||||||||||||||
193 RDLKAGNILLGEDGSVQIADFGVSAFLATGGDVTRNKVRKTFVGTPCWMA 242

111 PEVMEQVRGYDFKADMWSFGITAIELATGAAPYHKYPPMKVLMLTLQNDP 160
    ||||||||||||||||||||||||||||||||||||||||||||||||||
243 PEVMEQVRGYDFKADMWSFGITAIELATGAAPYHKYPPMKVLMLTLQNDP 292

161 PTLETGVEDKEMMKKYGKSFRKLLSLCLQKDPSKRPTAAELLKCKFFQKA 210
    ||||||||||||||||||||||||||||||||||||||||||||||||||
293 PTLETGVEDKEMMKKYGKSFRKLLSLCLQKDPSKRPTAAELLKCKFFQKA 342

211 KNREYLIEKLLTRTPDIAQRAKKVRRVPGSSGHLHKTEDGDWEWSDDEMD 260
    ||||||||||||||||||||||||||||||||||||||||||||||||||
343 KNREYLIEKLLTRTPDIAQRAKKVRRVPGSSGHLHKTEDGDWEWSDDEMD 392
```

FIG. 90

```
261 EKSEEGKAAFSQEKSRRVKEENPEIAVSASTIPEQIQSLSVHDSQGPPNA 310
    |||||||||||||||||||||||||||||||||||||||||||||||||
393 EKSEEGKAAFSQEKSRRVKEENPEIAVSASTIPEQIQSLSVHDSQGPPNA 442

311 NEDYREASSCAVNLVLRLRNSRKELNDIREFETPGRDTADGVSQELFSAG 360
    |||||||||||||||||||||||||||||||||||||||||||||||||
443 NEDYREASSCAVNLVLRLRNSRKELNDIREFETPGRDTADGVSQELFSAG 492

361 LVDGHDVVIVAANLQKIVDDPKALKTLTFKLASGCDGSEIPDEVKLIGFA 410
    |||||||||||||||||||||||||||||||||||||||||||||||||
493 LVDGHDVVIVAANLQKIVDDPKALKTLTFKLASGCDGSEIPDEVKLIGFA 542

411 QLSVS 415
    |||||
543 QLSVS 547
```

FIG. 90 (CONT.¹)

```
 11  VSGGSMLDIIKYIVNRGEHKNGVLEEAIIATILKEVLEGLDYLHRNGQIH   60
     :||||||||||||||||||||||||||||||||||||||||||||||||
143  LSGGSMLDIIKYIVNRGEHKNGVLEEAIIATILKEVLEGLDYLHRNGQIH  192

61  RDLKAGNILLGEDGSVQIADFGVSAFLATGGDVTRNKVRKTFVGTPCWMA  110
     |||||||||||||||||||||||||||||||||||||||||||||||||
193  RDLKAGNILLGEDGSVQIADFGVSAFLATGGDVTRNKVRKTFVGTPCWMA  242

111  PEVMEQVRGYDFKADMWSFGITAIELATGAAPYHKYPPMKVLMLTLQNDP  160
     |||||||||||||||||||||||||||||||||||||||||||||||||
243  PEVMEQVRGYDFKADMWSFGITAIELATGAAPYHKYPPMKVLMLTLQNDP  292

161  PTLETGVEDKEMMKKYGKSFRKLLSLCLQKDPSKRPTAAELLKCKFFQKA  210
     |||||||||||||||||||||||||||||||||||||||||||||||||
293  PTLETGVEDKEMMKKYGKSFRKLLSLCLQKDPSKRPTAAELLKCKFFQKA  342

211  KNREYLIEKLLTRTPDIAQRAKKVRRVPGSSGHLHKTEDGDWEWSDDEMD  260
     |||||||||||||||||||||||||||||||||||||||||||||||||
343  KNREYLIEKLLTRTPDIAQRAKKVRRVPGSSGHLHKTEDGDWEWSDDEMD  392
```

FIG. 91

```
261  EKSEEGKAAFSQEKSRRVKEENPEIAVSASTIPEQIQSLSVHDSQGPPNA  310
     |||||||||||||||||||||||||||||||||||||||||||||||||
393  EKSEEGKAAFSQEKSRRVKEENPEIAVSASTIPEQIQSLSVHDSQGPPNA  442

311  NEDYREASSCAVNLVLRLRNSRKELNDIREFTPGRDTADGVSQELFSAG   360
     ||||||||||||||||||||||||||||||||||||||||||||||||
443  NEDYREASSCAVNLVLRLRNSRKELNDIREFTPGRDTADGVSQELFSAG   492

361  LVDGHDVVIVAANLQKIVDDPKALKTLTFKL  391
     ||||||||||||||||||||||||||||||
493  LVDGHDVVIVAANLQKIVDDPKALKTLTFKL  523
```

FIG. 91 (CONT.¹)

VARIANTS OF PROTEIN KINASES

This application is a Continuation-In-Part of co-pending application Ser. No. 09/724,676, filed on Nov. 28, 2000, and for which priority is claimed under 35 U.S.C. § 120; and this application claims priority of Application Nos. 135619 and 136776 filed in Israel on Apr. 12, 2000 and Jun. 15, 2000, respectively, under 35 U.S.C. § 119; the entire contents of all are hereby incorporated by reference.

FIELD OF THE INVENTION

The present invention concerns novel nucleic acid sequences, vectors and host cells containing them, amino acid sequences encoded by said sequences, and antibodies reactive with said amino acid sequences, as well as pharmaceutical compositions comprising any of the above. The present invention further concerns methods for screening for candidate activator or deactivators utilizing said amino acid sequences.

BACKGROUND OF THE INVENTION

Alternative splicing (AS) is an important regulatory mechanism in higher eukaryotes (P. A. Sharp, *Cell* 77, 805–8152 (1994). It is thought to be one of the important mechanisms for differential expression related to tissue or development stage specificity. It is known to play a major role in numerous biological systems, including human antibody responses, sex determination in *Drosophila*, and (S. Stamm, M. Q. Zhang, T. G. Marr and D. M. Helfman, *Nucleic Acids Research* 22, 1515–1526 (1994); B. Chabot, *Trends Genet.* 12, 472–478 (1996); R. E. Breitbart, A. Andreadis, B. Nadal-Ginard, *Annual Rev. Biochem.*, 56, 467–495 (1987); C. W. Smith, J. G. Patton, B. Nadal-Ginard, *Annu. Rev. Genet.*, 27, 527–577 (1989).

Until recently it was commonly believed that alternative splicing existed in only a small fraction of genes (about 5%). A recent observation based on literature survey of known genes revises this estimate to as high as stating that at least 30% of human genes are alternatively spliced (M. S. Gelfand, I. Dubchak, I. Draluk and M. Zorn, *Nucleic Acids Research* 27, 301–302 (1999). The importance of the actual frequency of this phenomenon lies not only in the direct impact on the number of proteins created (100,000 human genes, for example, would be translated to a much higher number of proteins), but also in the diversity of functionality derived from the process.

Several mechanisms at different stages may be held responsible for the complexity of higher eukaryote which include: alternative splicing at the transcription level, RNA editing at the post-transcriptional level, and post-translational modifications are the ones characterized to date.

Kinases are enzymes that catalyze the phosphorylation of target proteins. This phosphorylation event causes activation, or at times inactivation, of the target protein. Kinases are divided into two major groups, based on the amino acid residue that they phosphorylate: tyrosine kinases and the more abundant group, serine/threonine kinases play a key role in the signal transduction mechanisms that control diverse biological processes, including cellular proliferation, differentiation, adhesion, mobility, survival and apoptosis, the immune response, neutrotransmission and cellular metabolism.

Alterations in the activity of various kinases have been extensively studied and linked to the pathogenesis of most major diseases, including cancer, central nervous system disorders, immune diseases/inflammations, asthma, autoimmune disease, arthritis, graft vs. host disease and transplantation complications, cardiovascular disease, liver disease, hormonal and metabolic disorders, osteoporosis, AIDS and other infectious disease.

A dominant negative is an inactive form of a protein that reduces or eliminates the activity of its active form. It may act by binding to the active protein and rendering it inactive, or where it is an enzyme by binding the target protein without enzymatically activating the protein, thus blocking and preventing the active enzymes from binding and activating the target protein. Dominant negative kinases might be alternatively spliced gene products, which lost an important site or domain, and thus became enzymatically inactive and therefor act as inhibitors of the active kinases, for example, by binding to the target protein without phosphorylating it and blocking the binding to other active kinases. By inhibiting the activity of the active kinases, the dominant negative kinases may interfere with a disease related process, such as cell proliferation in a tumor Kinase variants can act as dominant-negative inhibitors through a variety of mechanisms depending on their lost or defected site or domain. For example, truncated Growth Hormone Receptor that lacks most of its intracellular domain has been shown to heterodimerize with the full-length receptor, thus causing inhibition of signaling by Growth Hormone (Ross, R. J. M., *Growth hormone & IGF Research*, 9:42–46, 1999).

Direct specific inhibition of Protein Kinase C (PKC), for example, has been shown to initiate apoptosis in a variety of malignant cell types. Recently, two new alternatively spliced forms of PKC delta has been reported. The first—PKC delta II (mouse)—has 73 bp (26 amino acid) insertion at the caspase recognition region turning it to a caspase-resistant form.

The second—PKC delta III (rat)—has 83 bp insertion in the same region causing frame shift and forming truncated protein without the catalytic domain. That truncated form has been considered to act in a dominant-negative manner against the intact sub-type (Ueyama, T., et al., *Biochem. Biophys. Research Communications*, 269:557–563, 2000).

Many kinase inhibitors have clinical implications. They serve as drug targets or show potential for the treatment of many diseases, such as potential in the treatment of certain cancers and treatment of type II diabetes. Tyrosine kinase inhibitors have shown various effects in treatment of neurodegenerative disease including Alzheimer's and Parkinson's disease, prevention of restenosis following angioplasty, treatment of atherosclerosis, inflammation, thrombosis, autoimmune disease, allergy, asthma, transplant rejection, psoriasis, fibrosis, dwarfism and other growth disorders, as well as inhibiting the proliferation and function of natural killer cells (immunosuppressant effect).

Protein Kinase C (PKC) inhibitors are used in cardiovascular disease, diabetes, CNS disorders, arthritis, septic shock and inflammation bowel disease, and PKC inhibitors have shown also potential in the treatment of certain cancers and have been shown to initiate apoptosis in a variety of malignant cell types. p38 Kinase inhibitors may be effective in attenuating COX-2-mediated prostaglandins, inflammation, treatment of rheumatoid arthritis and inflammatory bowel diseases.

GLOSSARY

In the following description and claims use will be made, at times, with a variety of terms, and the meaning of such terms as they should be construed in accordance with the invention is as follows:

"Dominant negative kinase variant (DNKV) nucleic acid sequence"—the sequence shown in any one of the sequences denoted SEQ ID NO: 1 to SEQ ID NO: 91 sequences having at least 90% identity (see below) to said sequence and fragments (see below) of the above sequences of at least 20 b.p. long. These sequences are sequences coding for novel, naturally occurring, dominant negative kinase variants (DNKV) which may be obtained by alternative splicing of native and known genes. It should be emphasized that the novel variants of the present invention are naturally occurring sequences resulting from alternative splicing of genes and not merely artificially truncated, mutated or fragmented forms of known sequences. Thus the alternative dominant negative kinase variants of the invention have physiological significance as regards where, in what tissues, when, at which developmental stage and under which conditions (such as diseases, etc.) their expression is modulated, i.e., ceased, increased, up-regulated or down-regulated.

"DNKV product—also referred at times as the "DNKV protein" or "DNKV polypeptide"—is an amino acid sequence encoded by the DNKV nucleic acid sequence which is a naturally occurring mRNA sequence obtained as a result of alternative splicing. The amino acid sequence may be a peptide, a protein, as well as peptides or proteins having chemically modified amino acids (see below) such as a glycopeptide or glycoprotein. The term also includes homologues (see below) of said sequences in which one or more amino acids has been added, deleted, substituted (see below) or chemically modified (see below) as well as fragments (see below) of this sequence having at least 10 amino acids. More specifically, it concerns the amino acid sequences present in SEQ ID NO: 92 to SEQ ID NO: 182.

"Nucleic acid sequence"—a sequence composed of DNA nucleotides, RNA nucleotides or a combination of both types and may include natural nucleotides, chemically modified nucleotides and synthetic nucleotides.

"Amino acid sequence"—a sequence composed of any one of the 20 naturally appearing amino acids, amino acids which have been chemically modified (see below), or composed of synthetic amino acids.

"Fragment of DNKV nucleic acid sequence"—novel short stretch of nucleic acid sequences of at least 20 b.p., which does not appear as a continuous stretch in the original nucleic acid sequence (see below). The fragment may be a sequence which was previously undescribed in the context of the published RNA and which affects the amino acid sequence encoded by the known gene. For example, where the variant nucleic includes a sequence which was not included in the original sequence (a sequence which was an intron in the original sequence) the fragment includes that additional sequence. The fragment may also be a region which is not an intron, which was not present in the original sequence. Another example is when the variant lacks a non-terminal region which was present in the original sequence. The two stretches of nucleotides spanning this region (upstream and downstream of this region) are brought together by splicing in the variant, but are spaced from each by that region in the original sequence and are thus not continuous. A continuous stretch of nucleic acids comprising said two stretches of nucleotides, is not present in the original sequence and they are spaced at present in the variant and thus fall under the definition of fragment.

"Fragments of DNKV products"—novel amino acid sequences coded by the "fragment of DNKV nucleic acid sequence" defined above.

"Homologues of variants"—amino acid sequences of variants in which one or more amino acids has been added, deleted or replaced. The addition, deletion or replacement should be in regions or adjacent to regions where the variant differs from the original sequence (see below).

"Conservative substitution"—refers to the substitution of an amino acid in one class by an amino acid of the same class, where a class is defined by common physicochemical amino acid side chain properties and high substitution frequencies in homologous proteins found in nature, as determined, for example, by a standard Dayhoff frequency exchange matrix or BLOSUM matrix. [Six general classes of amino acid side chains have been categorized and include: Class I (Cys); Class II (Ser, Thr, Pro, Ala, Gly); Class III (Asn, Asp, Gln, Glu); Class IV (His, Arg, Lys); Class V (Ile, Leu, Val, Met); and Class VI (Phe, Tyr, Trp). For example, substitution of an Asp for another class III residue such as Asn, Gln, or Glu, is a conservative substitution.

"Non-conservative substitution"—refers to the substitution of an amino acid in one class with an amino acid from another class; for example, substitution of an Ala, a class II residue, with a class III residue such as Asp, Asn, Glu, or Gln.

"Chemically modified"—when referring to the product of the invention, means a product (protein) where at least one of its amino acid resides is modified either by natural processes, such as processing or other post-translational modifications, or by chemical modification techniques which are well known in the art. Among the numerous known modifications typical, but not exclusive examples include: acetylation, acylation, amidation, ADP-ribosylation, glycosylation, GPI anchor formation, covalent attachment of a lipid or lipid derivative, methylation, myristlyation, pegylation, prenylation, phosphorylation, ubiquitnation, or any similar process.

"Biologically active"—refers to the DNKV product having some sort of biological activity, for example, some physiologically measurable effect on target cells, molecules or tissues.

"Immunologically active"—defines the capability of a natural, recombinant or synthetic DNKV product, or any fragment thereof, to induce a specific immune response in appropriate animals or cells and to bind with specific antibodies. Thus, for example, an immunologically active fragment of DNKV product denotes a fragment which retains some or all of the immunological properties of the DNKV product, e.g can bind specific anti-DNKV product antibodies or which can elicit an immune response which will generate such antibodies or cause proliferation of specific immune cells which produce variant.

"Optimal alignment"—is defined as an alignment giving the highest percent identity score. Such alignment can be performed using a variety of commercially available sequence analysis programs, such as the local alignment program LALIGN using a ktup of 1, default parameters and the default PAM. A preferred alignment is the one performed using the CLUSTAL-W program from MacVector (TM), operated with an open gap penalty of 10.0, an extended gap penalty of 0.1, and a BLOSUM similarity matrix. If a gap needs to be inserted into a first sequence to optimally align it with a second sequence, the percent identity is calculated using only the residues that are paired with a corresponding amino acid residue (i.e., the calculation does not consider residues in the second sequences that are in the "gap" of the first sequence). In case of alignments of known gene sequences with that of the new variant, the optimal alignment invariably included aligning the identical parts of both sequences together, then keeping apart and unaligned the sections of the sequences that differ one from the other.

"Having at least 90% identity"—with respect to two amino acid or nucleic acid sequence sequences, refers to the percentage of residues that are identical in the two sequences when the sequences are optimally aligned. Thus, 90% amino acid sequence identity means that 90% of the amino acids in two or more optimally aligned polypeptide sequences are identical, however this definition explicitly excludes sequences which are 100% identical with the original sequence from which the variant of the invention was varied.

"Isolated nucleic acid molecule having an DNKV nucleic acid sequence"—is a nucleic acid molecule that includes the coding DNKV nucleic acid sequence. Said isolated nucleic acid molecule may include the DNKV nucleic acid sequence as an independent insert; may include the DNKV nucleic acid sequence fused to an additional coding sequences, encoding together a fusion protein in which the DNKV coding sequence is the dominant coding sequence (for example, the additional coding sequence may code for a signal peptide); the DNKV nucleic acid sequence may be in combination with non-coding sequences, e.g., introns or control elements, such as promoter and terminator elements or 5' and/or 3' untranslated regions, effective for expression of the coding sequence in a suitable host; or may be a vector in which the DNKV protein coding sequence is a heterologous.

"Expression vector"—refers to vectors that have the ability to incorporate and express heterologous DNA fragments in a foreign cell. Many prokaryotic and eukaryotic expression vectors are known and/or commercially available. Selection of appropriate expression vectors is within the knowledge of those having skill in the art.

"Deletion"—is a change in either nucleotide or amino acid sequence in which one or more nucleotides or amino acid residues, respectively, are absent.

"Insertion" or "addition"—is that change in a nucleotide or amino acid sequence which has resulted in the addition of one or more nucleotides or amino acid residues, respectively, as compared to the naturally occurring sequence.

"Substitution"—replacement of one or more nucleotides or amino acids by different nucleotides or amino acids, respectively. As regards amino acid sequences the substitution may be conservative or non-conservative.

"Antibody"—refers to IgG, IgM, IgD, IgA, and IgG antibody. The definition includes polyclonal antibodies or monoclonal antibodies. This term refers to whole antibodies or fragments of the antibodies comprising the antigen-binding domain of the anti-variant product antibodies, e.g. antibodies without the Fc portion, single chain antibodies, fragments consisting of essentially only the variable, antigen-binding domain of the antibody, etc.

"Treating a disease"—refers to administering a therapeutic substance effective to ameliorate symptoms associated with a disease, to lessen the severity or cure the disease, or to prevent the disease from occurring. Preferably the treatment of the disease by administration of the DNKV of the invention (either the protein or the nucleic acid sequence coding for the protein) is by the inhibition of the activation of the "original sequence" of the "counterpart kinase" (see below).

"Detection"—refers to a method of detection of a disease, disorder, pathological or normal condition. This term may refer to detection of a predisposition to a disease as well as for establishing the prognosis of the patient by determining the severity of the disease.

"Probe"—the DNKV nucleic acid sequence, or a sequence complementary therewith, when used to detect presence of other similar sequences in a sample. The detection is carried out by identification of hybridization complexes between the probe and the assayed sequence. The probe may be attached to a solid support or to a detectable label.

"Original sequence" or "original sequence of the counterpart kinase"—the amino acid or nucleic acid sequence of the kinase, from which the DNKV of the invention have been varied as a result of alternative splicing. The DNKV protein is believed to inhibit the activity of the counterpart kinase by a dominant negative mechanism as defined above.

"Data carrier"—a medium for holding informational data which is in a computer readable form. It may be a magnetic or non-magnetic data carrier.

SUMMARY OF THE INVENTION

The present invention is based on the finding of several novel, naturally occurring variants of protein kinases which lack a domain or region required for phosphorylation, and thus may be dominant negative kinases. The dominant negative kinase variants (DNKVs) of the invention are naturally occurring sequences which may be obtained by alternative splicing of known original sequences of the kinase genes. The novel DNKVs of the invention are not merely artificially truncated forms, fragments or mutations of known genes, but rather novel sequences which naturally occur within the body of individuals.

Each novel DNKV is a result of alternative splicing of an original counterpart kinase sequence. One original sequence may have one or more DNKV sequences derived therefrom by alternative splicing.

Thus, the DNKV protein of the invention may be used to inhibit the phosphorylation activity of its counterpart kinase, and thus may be used to treat diseases, wherein a beneficial therapeutical effect may be achieved by inhibiting the enzymatic activity of the counterpart kinase. The DNKV may be used as therapeutic agents which cause their beneficial effect by inhibition of kinase enzymatic activity.

The term "alternative splicing" in the context of the present invention and claims refers to: intron inclusion, exon exclusion, addition or deletion of terminal sequences in the DNKV as compared to the original kinase sequences.

The novel DNKV products of the invention typically have an opposite physiological activity from the activity featured by the original counterpart kinase from which they are originated (by alternative splicing), i.e. while the kinase phosphorylates proteins, the DNKVs do not have this enzymatic activity, but are able to inhibit the enzymatic activity of their counterpart kinases. Thus the DNKVs may serve as inhibitors of their counterpart kinases.

Typically the DNKV of the invention retains the binding properties of the original counterpart kinase while lacking its enzymatic activity or having a much lower level of such an activity and thus in fact neutralizes the activity of the kinase. The DNKV of the invention may further differ from the original sequence in various properties not directly connected to its biological activity such as in its stability, its clearance rate, tissue and cellular localization, its temporal pattern of expression, mechanisms for its up or down regulations, responses to agonists or antagonists, etc.

The main utility of the DNKVs of the invention is for neutralization the kinase activity of their kinase counterpart as will be explained hereinbelow.

The novel DNKVs may serve for detection purposes, i.e. their presence or level may be indicative of a disease, disorder, pathological or normal condition. Alternatively the ratio between the level variants and the level original peptide from which they were varied, or the ratio to other DNKVs (derived from the same original sequence) may be indicative to a disease, disorder, pathological or normal condition.

For example, for detectional purposes, it is possible to establish differential expression of various DNKVs in various tissues. A certain DNKV may be expressed mainly in one tissue, while the original kinase sequence from which it has been varied, or another variant derived from the same sequence, may be expressed mainly in another tissue. Understanding of the distribution of the variants in various tissues may be helpful in basic research, for understanding the physiological function of the genes as well as may help in targeting pharmaceuticals or developing pharmaceuticals.

The study of the DNKVs may also be helpful to distinguish various stages in the life cycles of cells which may also be helpful for development of pharmaceuticals for various pathological conditions in which cell cycles is non-normal, for example cancer.

Thus the detection may by determination of the presence or the level of expression of the DNKV within a specific cell population, comprising determining said presence or level and comparing it between various cell types in a tissue, between different tissues and between individuals.

Thus the present invention provides by its first aspect, a novel isolated nucleic acid molecule comprising or consisting of any one of the coding sequence SEQ ID NO: 1 to SEQ ID NO: 91, fragments of said coding sequence having at least 20 nucleic acids (provided that said fragments are continuous stretches of nucleotides not present in the original sequence from which the variant was varied), or a molecule comprising a sequence having at least 90%, identity to SEQ ID NO: 1 to SEQ ID NO: 91, provided that the molecule is not completely identical to the original kinase sequence from which the variant was varied.

The present invention further provides a protein or polypeptide comprising or consisting of an amino acid sequence encoded by any of the above nucleic acid sequences, termed herein "DNKV product", fragments of the above amino acid sequence having a length of at least 10 amino acids coded by the above fragments of the nucleic acid sequences, as well as homologues of the above amino acid sequences in which one or more of the amino acid residues has been substituted (by conservative or non-conservative substitution) added, deleted, or chemically modified. More specifically, the amino acid sequences are those denoted as SEQ ID NO: 92 to SEQ ID NO: 182.

The deletions, insertions and modifications should be in regions, or adjacent to regions, wherein the DNKV differs from the original sequence.

For example, where the DNKV is different from the original sequence by addition of a short stretch of 10 amino acids, in the terminal or non-terminal portion of the peptide, the invention also concerns homologues of that DNKV where the additional short stretch is altered for example, it includes only 8 additional amino acids, includes 13 additional amino acids, or it includes 10 additional amino acids, however some of them being conservative or non-conservative substitutes of the original additional 10 amino acids of the novel DNKVs. In all cases the changes in the homolog, as compared to the original sequence, are in the same regions where the DNKV differs from the original kinase sequence, or in regions adjacent to said region.

Another example is where the DNKV lacks a non-terminal region (for example of 20 amino acids) which is present in the original kinase sequence (due for example to exon exclusion). The homologues may lack in the same region only 17 amino acids or 23 amino acids. Again the deletion is in the same region where the DNKV lacks a sequence as compared to the original kinase sequence, or in a region adjacent thereto.

It should be appreciated that once a man versed in the art's attention is directed to the importance of a specific region, due to the fact that this region differs in the DNKV as compared to the original kinase sequence, there is no problem in derivating said specific region by addition to it, deleting from it, or substituting some amino acids in it. Thus homologues of DNKVs which are derived from the DNKV by changes (deletion, addition, substitution) only in said region as well as in regions adjacent to it are also a part of the present invention. Generally, if the DNKV is distinguished from the original kinase sequence by some sort of physiological activity, then the homolog is distinguished from the original kinase sequence in essentially the same manner.

The present invention further provides nucleic acid molecule comprising or consisting of a sequence which encodes the above amino acid sequences, (including the fragments and homologues of the amino acid sequences). Due to the degenerative nature of the genetic code, a plurality of alternative nucleic acid sequences, beyond those depicted in any one of SEQ ID NO: 1 to SEQ ID NO: 91, can code for the amino acid sequence of the invention. Those alternative nucleic acid sequences which code for the same amino acid sequences coded by the sequence SEQ ID NO:1 to SEQ ID NO:91 are also an aspect of the of the present invention.

The present invention further provides expression vectors and cloning vectors comprising any of the above nucleic acid sequences, as well as host cells transfected by said vectors.

The present invention still further provides pharmaceutical compositions comprising, as an active ingredient, said nucleic acid molecules, said expression vectors, or said protein or polypeptide. The pharmaceutical composition mainly acts through inactivation of the phosphorylation activity of the counterpart kinase, and may be used to treat diseases and conditions wherein a beneficial effect can be obtained by neutralizing the activity of any one of the counterpart kinases specified under "mRNA/Synonyms/Accession" in Table 1 below. More specifically, the diseases are those mentioned under "diseases" in Table 1 below.

Alternatively, these pharmaceutical compositions are suitable for the treatment of diseases and pathological conditions, which can be ameliorated, cured or prevented by raising the level of any one of the DNKV products of the invention.

By a second aspect, the present invention provides a nucleic acid molecule comprising or consisting of a non-coding sequence which is complementary to that of any one of SEQ ID NO: 1 to SEQ ID NO: 91, or complementary to a sequence having at least 90% identity to said sequence (with the proviso added above) or a fragment of said two sequences (according to the above definition of fragment). The complementary sequence may be a DNA sequence which hybridizes with any one of SEQ of ID NO: 1 to SEQ ID NO: 91 or hybridizes to a portion of that sequence having a length sufficient to inhibit the transcription of the complementary sequence. The complementary sequence may be a DNA sequence which can be transcribed into an mRNA being an antisense to the mRNA transcribed from any one of SEQ ID NO: 1 to SEQ ID NO: 91 or into an mRNA which is an antisense to a fragment of the mRNA transcribed from any one of SEQ ID NO: 1 to SEQ ID NO: 91 which has a length sufficient to hybridize with the mRNA transcribed from SEQ ID NO:1 to SEQ ID NO:91, so as to inhibit its translation. The complementary sequence may also be the mRNA or the fragment of the mRNA itself.

The nucleic acids of the second aspect of the invention may be used for therapeutic or diagnostic applications for example as probes used for the detection of the DNKVs of the invention.

The presence of the DNKV transcript or the level of the DNKV transcript (identified either by any one of SEQ ID NO: 1 to SEQ ID NO: 91 or by a sequence complementary thereto) may be indicative of a multitude of diseases, disorders and various pathological as well as normal conditions. In addition, the ratio of the level of the transcripts of the DNKVs of the invention may also be compared to that of the transcripts of the original kinase sequences from which they were varied, or to the level of transcript of other DNKVs, and said ratio may be indicative to a multitude of diseases, disorders and various pathological and normal conditions.

The present invention also provides expression vectors comprising any one of the above defined complementary nucleic acid sequences and host cells transfected with said nucleic acid sequences or vectors, being complementary to those specified in the first aspect of the invention.

The invention also provides anti-DNKV product antibodies, namely antibodies directed against the DNKV product which specifically bind to said DNKV product. Said antibodies are useful both for diagnostic and therapeutic purposes. For example said antibodies may be as an active ingredient in a pharmaceutical composition as will be explained below.

By another alternative, the invention concerns antibodies termed "distinguishing antibodies" which are directed solely to the amino acid sequences which distinguishes the DNKV from the original amino acid sequence from which it has been varied by alternative splicing. For example, where the contains 15 additional amino acids as compared to the original kinase sequence (due to intron inclusion) the antibodies may be directed against these additional amino acids (present in the DNKV and not present in the original kinase sequence). Another example is where the DNKV lacks 20 amino acids as compared to the original kinase sequence from which it is varied (for example due to exon exclusion). The distinguishing antibodies in that case may be directed only against these 20 amino acids which are present in the original kinase sequence and absent from the DNKV sequence.

The antibodies and the distinguishing antibodies may be used for detection purposes, i.e. to detect individuals, tissue, conditions (both pathological or physiological) wherein the DNKV sequence or original kinase sequence are evident or abundant. The antibodies may also be used to distinguish conditions where the level, or ratio of the DNKV to original kinase sequence is altered.

The antibodies and the distinguishing antibodies may also be used for therapeutical purposes, i.e., to neutralize only the DNKV product or only the product of the original kinase sequence, as the case may be, without neutralizing the other.

The present invention also provides pharmaceutical compositions comprising, as an active ingredient, the nucleic acid molecules which comprise or consist of said complementary sequences, or of a vector comprising said complementary sequences. The pharmaceutical composition thus provides pharmaceutical compositions comprising, as an active ingredient, said anti-DNKV product antibodies.

The pharmaceutical compositions comprising said anti-DNKV product antibodies or the nucleic acid molecule comprising said complementary sequence, are suitable for the treatment of diseases and pathological conditions where a therapeutically beneficial effect may be achieved by neutralizing the DNKV (either at the transcript or product level) or decreasing the amount of the variant product or blocking its binding to its target, for example, by the neutralizing effect of the antibodies, or by the decrease of the effect of the antisense mRNA in decreasing expression level of the DNKV product.

The DNKV products of the invention may also be used for screening of pharmaceuticals which interact only with the DNKV and not with the original kinase sequence, or vice versa, thereby choosing or tailoring pharmaceuticals having better specificity either to tissues, specific conditions or better specificity to proteins expressed by a specific individual.

According to the third aspect of the invention the present invention provides methods for detecting the level of the transcript (mRNA) of said DNKV product in a body fluid sample, or in a specific tissue sample, for example by use of probes comprising or consisting of said coding sequences which can hybridize and form hybridization complexes, or by use of primers for amplification; as well as methods for detecting levels of expression of said product in tissue, e.g. by the use of antibodies capable of specifically reacting with the DNKV products of the invention. Detection of the level of the expression of the DNKV of the invention, in particular as compared to that of the original kinase sequence from which it was varied, or compared to other DNKV sequences all varied from the same original kinase sequence may be indicative of a plurality of physiological or pathological conditions.

The method, according to this latter aspect, for detection of a nucleic acid sequence which encodes the DNKV product in a biological sample, comprises the steps of:

(a) providing a probe comprising at least one of the nucleic acid sequences defined above;

(b) contacting the biological sample with said probe under conditions allowing hybridization of nucleic acid sequences thereby enabling formation of hybridization complexes;

(c) detecting hybridization complexes, wherein the presence of the complex indicates the presence of nucleic acid sequence encoding the DNKV product in the biological sample.

By another option the present invention provides a method for detection of a nucleic acid sequence in a biological sample the method comprises:

(i) contacting the sample with probes for amplification of any one of SEQ ID NO: 1 to SEQ ID NO: 91;

(ii) proving reagents for amplification;

(iii) detecting the presence of amplified products, said products indicating the presence of DNKV nucleic acid in the sample.

The method as described above is qualitative, i.e. indicates whether the transcript is present in or absent from the sample. The method can also be quantitative, by determining the level of hybridization complexes and then calibrating said levels to determining levels of transcripts of the desired DNKV in the sample, or by determining the amount of amplified products and then calibrating said amplified amounts.

Both qualitative and quantitative determination methods can be used for diagnostic, prognostic and therapy planning purposes.

By a preferred embodiment the probe is part of a nucleic acid chip used for detection purposes, i.e. the probe is a part of an array of probes each present in a known location on a solid support.

The nucleic acid sequence used in the above method may be a DNA sequence, an RNA sequence, etc; it may be a coding or a sequence or a sequence complementary thereto (for respective detection of RNA transcripts or coding-DNA sequences). By quantization of the level of hybridization complexes and calibrating the quantified results it is possible also to detect the level of the transcript in the sample. If desired, the detected level may be compared to that of the original kinase sequence or compared to that of other splice DNKVs, for example, those obtained from the same original kinase sequence by alternative splicing.

Methods for detecting mutations in the region coding for the DNKV product are also provided, which may be methods carried-out in a binary fashion, namely merely detecting whether there is any mismatches between the normal DNKV nucleic acid sequence of the invention and the one present in the sample, or carried-out by specifically detecting the nature and location of the mutation.

The present invention also concerns a method for detecting DNKV product in a biological sample, comprising the steps of:

(a) contacting with said biological sample the antibody of the invention, thereby forming an antibody-antigen complex; and (b) detecting said antibody-antigen complex wherein the presence of said antibody-antigen complex correlates with the presence of DNKV product in said biological sample.

As indicated above, the method can be quantitized to determine the level or the amount of the DNKV in the sample, alone or in comparison to the level of the original amino acid sequence from which it was varied, and qualitative and quantitative results may be used for diagnostic, prognostic and therapy planning purposes.

By yet another aspect the invention also provides a method for identifying candidate compounds capable of binding to the DNKV product and modulating its activity (being either activators or deactivators). The method includes:

(i) providing a protein or polypeptide comprising an amino acid sequence substantially as coded by any one of SEQ ID NO: 92 to 182, or a fragment of such a sequence;

(ii) contacting a candidate compound with said amino acid sequence;

(iii) measuring the physiological effect of said candidate compound on the activity of the amino acid sequences and selecting those compounds which show a significant effect on said physiological activity.

The present invention also concerns compounds identified by the above methods described above, which compound may either be an activator of the variant product or a deactivator thereof.

The detection purposes mentioned above, utilizing detection of DNKV mRNA (by hybridization or amplification) or DNKV product (by antibodies) may be used to detect a plurality of diseases. The therapeutic purposes utilizing the DNKV sequence, expression vector, antisense DNKV, DNKV product or anti-DNKV antibody may also be used to treat a plurality of diseases. For each DNKV (referred to by its SEQ ID NO) the diseases to be detected or treated are those which are involved with any one of the kinase functions mentioned for each sequence in Table 1 below. More specifically examples of the diseases are mentioned in Table 1 below.

In the following Table 1 represents the new SEQ ID NO: of the current application (mentioned as NV#), "Nv 135619" is the number of the same new variant as depicted in IL Application No. 135619, and "Nv 09/724,676" is the number of the same new variant as mentioned in U.S. application Ser. No. 09/724,676. Also included in Table 1 below are mRNA definitions, Synonyms, Accession No. of the mRNA of the protein, diseases and literature

TABLE 1

| Nv # | Nv-135619 | Nv-09/724,676 | mRNA | Synonyms | Accession | Function | Potential Diseases | Literature |
|---|---|---|---|---|---|---|---|---|
| 1 | 29892 | 21235 | protein kinase/ endoribonulcease (IRE1) | | AF059198 | autophosphorylation activity and an endoribonuclease activity | | Tirasophon et al. Genes Dev. 12 (12), 1812–1824 (1998) |
| 2 | 683<br>30106 | | serine/threonine kinase RICK (RICK) | RIP2 | AF027706 | Regulate apoptosis induced by the CD95/Fas receptor pathway. Serine/threonine kinase. | | Inohara et al. J. Biol. Chem. 273 (20), 12296–12300 (1998) |
| 3 | 28225<br>47929 | 20035 | mRNA for beta-adrenergic receptor kinase | BETA-ARK-1; G-PROTEIN COUPLED RECEPTOR KINASE 2; ADRBK1; GRK2; BARK1; BARK. | X61157 | Specifically phosphorylates the agonist-occupied form of the beta-adrenergic. Belongs to the ser/thr family of protein kinases—family 1 of G-protein coupled receptor. | Congestive heart failure (CHF)—via the beta-adrenergic signaling cascade; Ischemia and reperfusion injury | |
| 4 | 28268 | 20069 | blk = protein tyrosine kinase [B lymphocytes, mRNA, 2608 nt] | B LYMPHOCYTE KINASE; P55-BLK | S76617 | Blk may function in a signal transduction pathway that is restricted to b lymphoid cells. | Thymic lymphoma (blk controls the proliferation of B-cell) | |
| 5 | 30582 | 21822 | CDK2 | P33 PROTEIN KINASE | X61622 | Serine/threonine protein kinase essential for progression of the mammalian cell cycle from G1 to S phase. Interacts with cyclins a, d, or e. Activity of cdk2 is maximal during S phase and G2. | Coronary artherosclerosis, Glomerulonephritis—a CDK antagonist decreased cell proliferation and matrix production, improving renal function; Lung carcinoma | Shiffman et al. J Biol Chem. May 24, 1996; 271(21): 12199–204. |

TABLE 1-continued

| Nv # | Nv-135619 | Nv-09/724,676 | mRNA | Synonyms | Accession | Function | Potential Diseases | Literature |
|---|---|---|---|---|---|---|---|---|
| 6 | 27993 | 19827 | PHKG1 | PHKG | X80590 | Phosphorylase b kinase catalyzes the phosphorylation of serine in certain substrates, including troponin i. Belongs to the ser/thr family of protein kinases. | Myopathy, Psoriasis—regulation of calcium-dependent phosphorilation in the epidermis. Disturbance of PK activity may play an important role in the clinical manifestations of the disease!! | |
| 7 | 28503 | 20276 | (clone PK2J) CDC2-related protein kinase (PISSLRE) | CDK10 | L33264 | Belongs to the ser/thr family of protein kinases. Cdc2/cdkx subfamily. | | |
| 8 | 28504 | 20277 | (clone PK2J) CDC2-related protein kinase (PISSLRE) | CDK10 | L33264 | Belongs to the ser/thr family of protein kinases. Cdc2/cdkx subfamily | | |
| 9 | 28508 | 20281 | (clone PK2J) CDC2-related protein kinase (PISSLRE) | CDK10 | L33264 | Belongs to the ser/thr family of protein kinases. Cdc2/cdkx subfamily | | |
| 10 | 28313 | 20114 | mRNA for phosphatidylinositol 3-kinase | PI3-KINASE P110; PTDINS-3-KINASE; PI3K. | Z46973 | Enzymes involved in receptor signal transduction, serine/threonine kinase. Phosphorylates ptdins, ptdins4p and ptdins(4,5)p2 | | Volinia et al. EMBO J. Jul. 17, 1995; 14(14): 3339–48. |
| 11 | 28315 | 20115 | mRNA for phosphatidylinositol 3-kinase | | Z46973 | | | |
| 12 | 30963 | 22071 | mRNA for cAMP-dependent protein kinase catalytic subunit type | PKA C-ALPHA | X07767 M36872 | Belongs to the ser/thr family of protein kinases. Camp subfamily. | Inflammation and pain (after injury); Leukaemia; Osteosarcoma; Colon carcinoma; Wilms' tumor—PKA modulates the activity of this tumor suppressor gene. Lewis lung carcinoma—kinase inhibitors affect tumor progression. OCD—PKA has a role in the pathophysiology | |
| 13 | 28413 | 20208 | mRNA for protein kinase C-Epsilon | NPKC-EPSILON; PRKCE; PKCE. | X65293 S46030 | This is calcium-independent, phospholipid-dependent, serine- and threonine-specific enzyme. pkc is activated by diacylglycerol which in turn phosphorylates a range of cellular proteins, pkc also serves as the receptor for phorbol esters a class of tumor promoters. | Cardiac hypertrophy and failure; Chronic diabetes—via phosphorilation of important regulatory proteins; Skin tumor; Neuroblastoma-inhibitors inhibited uridine-induced cell differentiation!!! | Basta et al. Biochim. Biophys. Acta 1132: 154–160 (1992). |

TABLE 1-continued

| Nv # | Nv-135619 | Nv-09/724,676 | mRNA | Synonyms | Accession | Function | Potential Diseases | Literature |
|---|---|---|---|---|---|---|---|---|
| 14 | 28429 48375 | 20224 | mRNA for receptor protein tyrosine kinase | TYROSINE-PROTEIN KINASE TYRO 10; NEUROTROPHIC TYROSINE KINASE, RECEPTOR-RELATED 3 | X74764 | Belongs to the insulin receptor family of tyrosine-protein kinases. | | Karn et al. Oncogene 8 (12), 3433–3440 (1993) |
| 15 | 29504 56875 | 20901 | mRNA for leucine zipper bearing kinase | | AB001872 | Association of LZK in the c-Jun amino-terminal kinase/stress-activated protein kinase pathway | | Sakuma et al. J. Biol. Chem. 272 (45), 28622–28629 (1997) |
| 16 | 28442 | | nek3 mRNA for protein kinase | NIMA-RELATED PROTEIN KINASE 3; HSPK 36 | Z29067 | Kinase that may play a role in mitotic regulation. | Might be candidate for usher syndrome, because of its chromosomal location. | Schultz et al. Cell Growth Differ. 4: 821–830 (1993). |
| 17 | 30256 | 21510 | JAK family protein tyrosine kinase (JAK3) | JANUS KINASE 3; JAK-3; LEUKOCYTE JANUS KINASE; L-JAK. | U09607 | Tyrosine kinase of the non-receptor type, involved in the interleukin-2 and interleukin-4 signaling pathway. Phosphorylates stat6, irs1, irs2 and pi3k. | Glomerular injury (nephropathy); via signal transduction Amyotrophic lateral sclerosis (ALS)—inhibitors increased survival. Atopic dermatitis (AD) T-cell tumors (suppressed proliferation when the kinase is down-regulated) Leukaemia | Kawamura et al. Proc. Natl. Acad. Sci. U.S.A. 91: 6374–6378 (1994). |
| 18 | 31681 48558 | 22609 | activin type I receptor | ACTR-I; SKR1; TGF-B SUPERFAMILY RECEPTOR TYPE I; TSR-I | U14722 | Receptor for activin. Belongs to the ser/thr family of protein kinases. Tgfb receptor subfamily. | | Xu et al. |
| 19 | 30359 | 21604 | MEK kinase 3 mRNA | MAPK/ERK KINASE KINASE 3; MEK KINASE 3; MEKK 3 | U78876 | Preferentially activates p42/44 (erk2/erk1) map kinases. Belongs to the ser/thr family of protein kinases. Map kinase kinase kinase subfamily. | | Ellinger et al. J. Biol. Chem. 272: 2668–2674 (1997). |
| 20 | 30361 | 21606 | MEK kinase 3 mRNA | MAPK/ERK KINASE KINASE 3; MEK KINASE 3; MEKK 3 | U78876 | Preferentially activates p42/44 (erk2/erk1) map kinases. Belongs to the ser/thr family of protein kinases. Map kinase kinase kinase subfamily. | | Ellinger et al. J. Biol. Chem. 272: 2668–2674 (1997). |

TABLE 1-continued

| Nv # | Nv- 135619 | Nv- 09/724,676 | mRNA | Synonyms | Accession | Function | Potential Diseases | Literature |
|---|---|---|---|---|---|---|---|---|
| 21 | 28572 | 20335 | CDC2-related kinase (PITALRE) | C-2K; CDK9. | L25676 | Member of the cyclin-dependent kinase pair (cdk9/cyclin t) complex, also called positive transcription elongation factor b (p-tefb), which is proposed to facilitate the transition from abortive to production elongation by phosphorylating the ctd (carboxy-terminal domain) of the large subunit of rna polymerase ii (map ii). The cdk9/cyclin k complex has also a kinase activity toward ctd of map ii and can substitute for p-tefb in vitro. In vitro, phosphorylates retinoblastoma and myelin basic protein. | | Grana et al. Proc. Natl. Acad. Sci. U.S.A. 91: 3834–3838 (1994). |
| 22 | 16674305 9145731 | | (clone PSK-J3) cyclin-dependent protein kinase | CYCLIN-DEPENDENT KINASE 4; PSK-J3 | M14505 | Probably involved in the control of the cell cycle. | Oncogene in soft-tissue sarcoma; malignant melanoma; glioma; lung cancer; leukaemia; breast cancer. | Hanks et al. Proc. Natl. Acad. Sci. U.S.A. 84, 388–392 (1987) |
| 23 | 16675305 9245732 | | (clone PSK-J3) cyclin-dependent protein kinase | CYCLIN-DEPENDENT KINASE 4; PSK-J3 | M14505 | Probably involved in the control of the cell cycle. | Oncogene in soft-tissue sarcoma; malignant melanoma; glioma; lung cancer; leukaemia; breast cancer. | Hanks et al. Proc. Natl. Acad. Sci. U.S.A. 84, 388–392 (1987) |
| 24 | 30252 | 21506 | G protein-coupled receptor kinase (GRK5) | GPRK5 | L15388 | Specifically phosphorylates the activated forms of g protein-coupled receptors. | | Kunapuli et al. Proc. Natl. Acad. Sci. U.S.A. 90 (12), 5588–5592 (1993) |
| 25 | 30254 | 21508 | G protein-coupled receptor kinase (GRK5) | GPRK5 | L15388 | Specifically phosphorylates the activated forms of g protein-coupled receptors. | | Kunapuli et al. Proc. Natl. Acad. Sci. U.S.A. 90 (12), 5588–5592 (1993) |
| 26 | 30255 | 21509 | G protein-coupled receptor kinase (GRK5) | | L15388 | Specifically phosphorylates the activated forms of g protein-coupled receptors. | | Kunapuli et al. Proc. Natl. Acad. Sci. U.S.A. 90 (12), 5588–5592 (1993) |

TABLE 1-continued

| Nv # | Nv-135619 | Nv-09/724,676 | mRNA | Synonyms | Accession | Function | Potential Diseases | Literature |
|---|---|---|---|---|---|---|---|---|
| 27 | 29592 | 20987 | protein kinase C-delta 13 | NPKC-DELTA | L07860 | This is calcium-independent, phospholipid-dependent, serine- and threonine-specific enzyme. Pkc is activated by diacylglycerol which in turn phosphorylates a range of cellular proteins. pkc also serves as the receptor for phorbol esters, a class of tumor promoters. | Mammary tumor; Ischemia (inhibited by PKC antagonists) | Aris et al. Biochim. Biophys. Acta 1174, 171–181 (1993) |
| 28 | 31320 | 22302 | phosphorylase kinase (PSK-C3) | PHK-GAMMA-T | M31606 | Increasing levels of PSK-C3 mrna in the testis correlate with postnatal testicular development, suggesting possible hormonal regulation of gene transcription. Belongs to the ser/thr family of protein kinases. | Responsible for approximately 25% of cases of glycogen storage disease. affected tissues: liver only, muscle only, liver and muscle, liver and kidney, heart only. | Hanks et al. Mol. Endocrinol. 3, 110–116 (1989) |
| 29 | 31562 | 22492 | protein-tyrosine kinase (JAK1) | JANUS KINASE 1 | M64174 M35203 | Tyrosine kinase of the non-receptor type, involved in the ifn-alpha/beta/gamma signal pathway. Kinase partner for the interleukin (il)-2 receptor. Belongs to the janus kinases subfamily. | | Wilks et al. Mol. Cell. Biol. 11: 2057–2065 (1991). |
| 30 | 31712 | 22640 | src-like kinase (slk) mRNA | P59-FYN; SYN | M14676 | Implicated in the control of cell growth. | Alcoholism; autoimmune. Osteoporosis; Cancer. | Semba et al. Proc. Natl. Acad. Sci. U.S.A. 83: 5459–5463 (1986). |
| 31 | 31723 | 22651 | src-like kinase (slk) mRNA | P59-FYN; SYN | M14676 | Implicated in the control of cell growth. | Alcoholism; autoimmune. Osteoporosis; Cancer. | Semba et al. Proc. Natl. Acad. Sci. U.S.A. 83: 5459–5463 (1986). |
| 32 | 29889 | 21232 | protein kinase (HSTPK13) | SERINE-THREONINE PROTEIN KINASE 13; STPK13; PLK; PLK1 | L19559 | May be required for cell division and may have a role during g1 or s phase. | Erythroleukaemia. | Hamanaka et al. Cell Growth Differ. 5: 249–257 (1994). |
| 33 | 29034 | 20669 | casein kinase I epsilon | CKI-EPSILON | L37043 | Casein kinases are operationally defined by their preferential utilization of acidic Proteins such as caseins as substrates. It can phosphorylate a large number of proteins. Belongs to the ser/thr family of protein kinases. Casein kinase i subfamily | | Fish et al. J. Biol. Chem. 270: 14875–14883 (1995). |

TABLE 1-continued

| Nv # | Nv-135619 | Nv-09/724,676 | mRNA | Synonyms | Accession | Function | Potential Diseases | Literature |
|---|---|---|---|---|---|---|---|---|
| 34 | 29035 | 20670 | casein kinase I epsilon | CKI-EPSILON | L37043 | Casein kinases are operationally defined by their preferential utilization of acidic Proteins such as caseins as substrates. It can phosphorylate a large number of proteins. Belongs to the ser/thr family of protein kinases. Casein kinase i subfamily. | | Fish et al. J. Biol. Chem. 270: 14875–14883 (1995). |
| 35 | 29036 | 20671 | casein kinase I epsilon | CKI-EPSILON | L37043 | Casein kinases are operationally defined by their preferential utilization of acidic Proteins such as caseins as substrates. It can phosphorylate a large number of proteins. Belongs to the ser/thr family of protein kinases. Casein kinase i subfamily. | | Fish et al. J. Biol. Chem. 270: 14875–14883 (1995). |
| 36 | 30573 | 21813 | cdc2-related protein kinase (CHED) | CHOLINESTERASE-RELATED CELL DIVISION CONTROLLER; CDC2-RELATED PROTEIN KINASE 5 | M80629 | Controller of the mitotic cell cycle. Involved in the blood cell development. | cholinergic signals in the hematopoietic pathway—antisense oligonucleotide inhibited megakaryocyte development in bone marrow cultures. | Lapidot-Lifson et al. Proc. Natl. Acad. Sci. U.S.A. 89 (2), 579–583 (1992) |
| 37 | 2682 28583 | 20345 | CDC42-binding protein kinase beta (CDC42BPB) | | AF128625 | Phosphorylate nonmuscle myosin light chain, a prerequisite for the activation of actin-myosin contractility. | | Moncrieff et al. Submitted (Feb. 9, 1999) Division of Molecular Genetics, IBLS, Glasgow University, 56 Dumbarton Road, Glasgow G11 6NU, UK |
| 38 | 2683 28584 | 20346 | CDC42-binding protein kinase beta (CDC42BPB) | | AF128625 | Phosphorylate nonmuscle myosin light chain, a prerequisite for the activation of actin-myosin contractility. | | Moncrieff et al. Submitted (Feb. 9, 1999) Division of Molecular Genetics, IBLS, Glasgow University, 56 Dumbarton Road, Glasgow G11 6NU, UK |
| 39 | 30504 | 21744 | casein kinase I delta | CKI-DELTA | U29171 | Casein kinases are operationally defined by their preferential utilization of acidic proteins such as caseins as substrates. It can phosphorylate a large number of proteins. Belongs to the ser/thr family of protein kinases. Casein kinase i subfamily. | Neurodegenerative diseases (abnormal processing of tau which involved in many diseases) | Kusuda et al. Genomics 32 (1), 140–143 (1996) |

TABLE 1-continued

| Nv # | Nv-135619 | Nv-09/724,676 | mRNA | Synonyms | Accession | Function | Potential Diseases | Literature |
|---|---|---|---|---|---|---|---|---|
| 40 | 29500 | 20899 | mRNA for diacylglycerol kinase delta | DIGLYCERIDE KINASE; DGK-DELTA; DAG KINASE DELTA; 80 KDA DIACYL-GLYCEROL KINASE | D73409 | Similar to those of the EPH family of Protein-tyrosine kinases | | Sakane et al. J. Biol. Chem. 271: 8394–8401 (1996). |
| 41 | 31626 | 22555 | rac protein kinase alpha | RAC-PK-ALPHA; PROTEIN KINASE B; PKB | M63167 | General kinase capable of phosphorilating several known proteins | | Konishi et al. Biochem. Biophys. Res. Commun. 205: 817–825 (1994). |
| 42 | 28696 | 20379 | STE20-related protein kinase | | AB013385 | | Dementia; parkinsonism (only potentially because of mutation locus) | |
| 43 | 28704 | 20386 | STE20-related protein kinase | | AB013385 | | Dementia; parkinsonism (only potentially because of mutation locus) | |
| 44 | 28720 | 20399 | STE20-related protein kinase | | AB013385 | | Dementia; parkinsonism (only potentially because of mutation locus) | |
| 45 | 3163149242 | 22560 | receptor tyrosine kinase (HEK) | TYROSINE-PROTEIN KINASE RECEPTOR ETK1 | M83941 | HEK is a member of the EPH/ELK family of receptor tyrosine kinases. | | Wicks et al. Proc. Natl. Acad. Sci. U.S.A. 89 (5), 1611–1615 (1992) |
| 46 | 31672 | 22601 | ser-thr protein kinase PK428 | | U59305 | Protein kinase related to the myotonic dystrophy Protein kinase family | similar to DMPK (Myotonic dystrophy) | Zhao et al. Submitted (MAY-1996) to the EMBL/GenBank/DDBJ databases. |
| 47 | 30095 | 21393 | serine threonine kinase 11 (STK11) | SERINE/THREONINE-PROTEIN KINASE LKB1 | AF035625 | May be a member of a yet unidentified signaling pathway and it may act as a tumor-suppressor. | Mutation causes the Peutz-Jeghers syndrome (PJS), a rare hereditary disease in which there is predisposition to benign and malignant tumors of many organ systems. Pjs is an autosomal-dominant disorder characterized by melanocytic macules of the lips, multiple gastrointestinal hamartomatous polyps and an increased risk for various neoplasms, including gastrointestinal cancer. Many splice variants are known. | Nezu J.; Submitted (AUG-1996) to the EMBL/GenBank/DDBJ databases. |

TABLE 1-continued

| Nv # | Nv-135619 | Nv-09/724,676 | mRNA | Synonyms | Accession | Function | Potential Diseases | Literature |
|---|---|---|---|---|---|---|---|---|
| 48 | 30096 | 21394 | serine threonine kinase 11 (STK11) | SERINE/ THREONINE-PROTEIN KINASE LKB1 | AF035625 | May be a member of a yet unidentified signaling pathway and it may act as a tumor-suppressor. | Mutation causes the Peutz-Jeghers syndrome (PJS), a rare hereditary disease in which there is predisposition to benign and malignant tumors of many organ systems. Pjs is an autosomal-dominant disorder characterized by melanocytic macules of the lips, multiple gastrointestinal hamartomatous polyps and an increased risk for various neoplasms, including gastrointestinal cancer. Many splice variants are known. | Nezu J.; Submitted (AUG-1996) to the EMBL/GenBank/ DDBJ databases. |
| 49 | 28913 | 20573 | RIP-like kinase (RIP3) | | AF156884 | An adaptor proteins that contain death domains. RIP3 appears to function as an intermediary in tnfalpha-induced apoptosis. | | Yu, et al. Curr. Biol. 9 (10), 539–542 (1999) |
| 50 | 28768 | 20439 | IkB kinase-b (IKK-beta) | | AF080158 | Serine/threonine kinases which has been identified as ikappab kinase which is essential for ikappab phosphorylation and NF-kappab activation | The activity of the kinase prevents the pathogenesis of the inflammatory response. | Hu et al. Gene 222 (1), 31–40 (1998) |
| 51 | 30947 | 22055 | mRNA for LIMK (LIM kinase) | LIMK-1 | D26309 | May be a component of an intracellular signaling pathway and may be involved in brain Development. Displays serine/ threonine-specific phosphorylation of myelin basic protein and Histone (mbp) in vitro. | Limk1 seems to be implicated in williams syndrome (ws), a disease characterized by impaired visuospatial constructive cognition. | Mizuno et al. Oncogene 9: 1605–1612 (1994). |
| 52 | 30948 | 22056 | mRNA for LIMK (LIM kinase) | | D26309 | | | |
| 53 | 30896 | 22014 | mRNA for novel protein kinase PKN | PROTEIN-KINASE C-RELATED KINASE 1; PROTEIN KINASE C-LIKE PKN; SERINE-THREONINE PROTEIN KINASE N | D26181 | Can phosphorylate ribosomal protein s6. Mediates gtpase rho dependent intracellular signalling (by similarity). | | Palmer et al. Eur J Biochem. Jan. 15, 1995; 227(1–2): 344–51. |

TABLE 1-continued

| Nv # | Nv-135619 | Nv-09/724,676 | mRNA | Synonyms | Accession | Function | Potential Diseases | Literature |
|---|---|---|---|---|---|---|---|---|
| 54 | 30900 | 22018 | mRNA for novel protein kinase PKN | PROTEIN-KINASE C-RELATED KINASE 1; PROTEIN KINASE C-LIKE PKN; SERINE-THREONINE PROTEIN KINASE N | D26181 | Can phosphorylate ribosomal protein s6. Mediates gtpase rho dependent intracellular signalling (by similarity). | | Palmer et al. Eur J Biochem. Jan. 15, 1995; 227(1–2): 344–51 |
| 55 | 29052 | 20685 | cell cycle related kinase | CDCH; CYCLIN-DEPENDENT PROTEIN KINASE H | AF035013 | | cholinergic signals in the hematopoietic pathway—antisense oligonucleotide inhibited megakaryocyte development in bone marrow cultures. | Jiang Y., Zhao K.; Submitted (NOV-1997) to the EMBL/GenBank/ DDBJ databases. |
| 56 | 29494 | 20894 | mRNA for ZIP-kinase | ZIPK | AB007144 | Serine/threonine kinase which mediates apoptosis. | | Kawai et al. Mol Cell Biol. 1998 Mar; 18(3): 1642–51. |
| 57 | 29158 | 20739 | diacylglycerol kinase iota (DGKi) | DGKI | AF061936 | Diacylglycerol (DAG) plays a central role in both the synthesis of complex lipids and in intracellular signaling; may have important cellular functions in the retina and brain. | | Bowne et al. |
| 58 | 28184494 23 | | RYK = related to receptor tyrosine kinase [hepatoma] | | S59184 | Potential growth factor receptor protein tyrosine kinase. The expression of this receptor tyrosine kinase in Epithelial ovarian cancer suggests that it may be involved in tumor progression, which needs further investigation. | Protooncogene for chicken sarcoma (new variant-soluble) | Wang et al. Mol Med. 1996 Mar; 2(2): 189–203. |
| 59 | 28191494 30 | 20001 | RYK = related to receptor tyrosine kinase [hepatoma] | | S59184 | Potential growth factor receptor protein tyrosine kinase. The expression of this receptor tyrosine kinase in Epithelial ovarian cancer suggests that it may be involved in tumor progression, which needs further investigation. | Protooncogene for chicken sarcoma (new variant-soluble) | Wang et al. Mol Med. 1996 Mar; 2(2): 189–203. |

TABLE 1-continued

| Nv # | Nv-135619 | Nv-09/724,676 | mRNA | Synonyms | Accession | Function | Potential Diseases | Literature |
|---|---|---|---|---|---|---|---|---|
| 60 | 31060 | | myotonin protein kinase = thymopoietin homolog [muscle] | MYOTONIC DISTROPHY PROTEIN KINASE; MDPK; DM-KINASE; DMK; DMPK; MT-PK | S72883 | May play a role in the intracellular communication. | Defects in dmpk are the cause of myotonic distrophy (dm), an autosomal dominant neurodegenerative disorder characterized by myotonia, muscle wasting in the distal extremities, cataract, hypogonadism, defective endocrine functions, male baldness, and cardiac arrhythmias. DM patients show decreased levels of kinase expression inversely related to repeat length. The minimum estimated incidence is 1 in 8000. | Fu et al. Science 255: 1256–1258 (1992). |
| 61 | 31084 | | myotonin protein kinase = thymopoietin homolog [muscle] | MYOTONIC DISTROPHY PROTEIN KINASE; MDPK; DM-KINASE; DMK; DMPK; MT-PK | S72883 | May play a role in the intracellular communication. | Defects in dmpk are the cause of myotonic distrophy (dm), an autosomal dominant neurodegenerative disorder characterized by myotonia, muscle wasting in the distal extremities, cataract, hypogonadism, defective endocrine functions, male baldness, and cardiac arrhythmias. DM patients show decreased levels of kinase expression inversely related to repeat length. The minimum estimated incidence is 1 in 8000. | Fu et al. Science 255: 1256–1258 (1992). |
| 62 | 28566548 95 | | ATP sulfurylase/APS kinase | PAPS SYNTHETHASE 1; PAPSS 1; SULFURYLASE KINASE 1; SK1 | AF016496 | Bifunctional enzyme with both atp sulfurylase and aps kinase activity, which mediates two steps in the sulfate activation pathway. The first step is the transfer of a sulfate group to atp to yield adenosine 5'-phosphosulfate (aps), and the second step is the transfer of a phosphate group from atp to aps yielding 3'-phosphoadenylyl-sulfate (paps: activated sulfate donor used by sulfotransferase). In mammals, paps is the sole source of sulfate; aps | | Li et al. J. Biol. Chem. 270: 29453–29459 (1995). |

TABLE 1-continued

| Nv # | Nv-135619 | Nv-09/724,676 | mRNA | Synonyms | Accession | Function | Potential Diseases | Literature |
|---|---|---|---|---|---|---|---|---|
| | | | | | | appears to be only an intermediate in the sulfate-activation pathway. Also involved in the biosynthesis of sulfated 1-selectin ligands in endothelial cells. | | |
| 63 | 28524 | 20294 | 3-phosphoinositide dependent protein kinase-1 (PDK1) | | AF017995 | | | Alessi et al. Curr. Biol. 7: 261–269 (1997). |
| 64 | 29614 | | AKT3 protein kinase | RAC-PK-GAMMA; PROTEIN KINASE AKT-3; PROTEIN KINASE B, GAMMA; PKB GAMMA | AF135794 | Igf-1 leads to the activation of akt3, which may play a role in regulating cell survival. Capable of phosphorylating several known proteins. | | Nakatani et al. Biochem. Biophys. Res. Commun. 257: 906–910 (1999). |
| 65 | 29615 | | AKT3 protein kinase | RAC-PK-GAMMA; PROTEIN KINASE AKT-3; PROTEIN KINASE B, GAMMA; PKB GAMMA | AF135794 | Igf-1 leads to the activation of akt3, which may play a role in regulating cell survival. Capable of phosphorylating several known proteins. | | Nakatani et al. Biochem. Biophys. Res. Commun. 257: 906–910 (1999). |
| 66 | 29620 | 21010 | AKT3 protein kinase | RAC-PK-GAMMA; PROTEIN KINASE AKT-3; PROTEIN KINASE B, GAMMA; PKB GAMMA | AF135794 | Igf-l leads to the activation of akt3, which may play a role in regulating cell survival. Capable of phosphorylating several known proteins. | | Nakatani et al. Biochem. Biophys. Res. Commun. 257: 906–910 (1999). |
| 67 | 30109 | 21401 | serum-inducible kinase | | AF059617 | | | Ouyang et al. Oncogene 18 (44), 6029–6036 (1999) |
| 68 | 30111 | 21403 | serum-inducible kinase | | AF059617 | | | Ouyang et al. Oncogene 18 (44), 6029–6036 (1999) |
| 69 | 30112 | 21404 | serum-inducible kinase | | AF059617 | | | Ouyang et al. Oncogene 18 (44), 6029–6036 (1999) |
| 70 | | | myristilated and palmitylated serine-threonine kinase | | AF060798 | | | Berson A. E.; Submitted (APR-1998) to the EMBL/GenBank/ DDBJ databases. |
| 71 | 2916067864 | 20741 | eukaryotic translation initiation factor 2 alpha kinase PEK mRNA | | AF110146 | | Mutations may cause the Wolcott-Rallison syndrome. | Shi et al. J. Biol. Chem. 274: 5723–5730 (1999). |
| 72 | 30374 | 21619 | activated p21cdc42Hs kinase (ack) | | L13738 | signal transduction | | Manser et al. Nature 363 (6427), 364–367 (1993) |
| 73 | 30904 | 22022 | lipid-activated, protein kinase PRK2 | PROTEIN-KINASE C-RELATED KINASE 2 | U33052 | Exhibits a preference for highly basic protein substrates (by similarity). | | Palmer et al. Eur. J. Biochem. 227 (1–2), 344–351 (1995) |
| 74 | 30905 | 22023 | lipid-activated, protein kinase PRK2 | PROTEIN-KINASE C-RELATED KINASE 2 | U33052 | Exhibits a preference for highly basic protein substrates (by similarity). | | Palmer et al. Eur. J. Biochem. 227 (1–2), 344–351 (1995) |
| 75 | 29406 | 20850 | mRNA for MNK1 | | AB000409 | MAP kinase-activated protein kinase | | Fukunaga et al. EMBO J. 16: 1921–1933 (1997). |

TABLE 1-continued

| Nv # | Nv-135619 | Nv-09/724,676 | mRNA | Synonyms | Accession | Function | Potential Diseases | Literature |
|---|---|---|---|---|---|---|---|---|
| 76 | 29408 | 20852 | mRNA for MNK1 | | AB000409 | MAP kinase-activated protein kinase | | Fukunaga et al. EMBO J. 16: 1921–1933 (1997). |
| 77 | 29414 | 20857 | mRNA for MNK1 | | AB000409 | MAP kinase-activated protein kinase | | Fukunaga et al. EMBO J. 16: 1921–1933 (1997). |
| 78 | 28928 | | STE20-like kinase (JIK) | | AF179867 | | | Tassi et al. J. Biol. Chem. 274: 33287–33295 (1999). |
| 79 | 30124 | 21411 | tousled-like kinase 2 (TLK2) | | AF162667 | serine/threonine protein kinase | | Sillje et al. EMBO J. 18: 5691–5702 (1999). |
| 80 | 29341 | 20805 | interleukin-1 receptor-associated kinase (IRAK) | | L76191 | Involved in il-1 pathway. This kinase associates with the il-1 receptor il1-r-1. This association is rapid and il-1 dependent. | | Cao et al. Science 271: 1128–1131 (1996). |
| 81 | 29344 | 20808 | interleukin-1 receptor-associated kinase (IRAK) | | L76191 | Involved in il-1 pathway. This kinase associates with the il-1 receptor il1-r-1. This association is rapid and il-1 dependent. | | Cao et al. Science 271: 1128–1131 (1996). |
| 82 | 29349 | 20812 | interleukin-1 receptor-associated kinase (IRAK) | | L76191 | Involved in il-1 pathway. This kinase associates with the il-1 receptor il1-r-1. This association is rapid and il-1 dependent. | | Cao et al. Science 271: 1128–1131 (1996). |
| 83 | 30850 | 21975 | insulin-stimulated protein kinase 1 (ISPK-1) | S6K-ALPHA 3; 90 KDA RIBOSOMAL PROTEIN S6 KINASE 3; P90-RSK 3; RIBOSOMAL S6 KINASE 2; RSK-2; PP90RSK2 | U08316 | Phosphorylates a wide range of substrates including ribosomal protein s6. Implicated in the activation of the mitogen-activated kinase cascade. | Defects in rps6ka3 are the cause of coffin-lowry syndrome (cls). The features of this diseases are severe mental retardation with facial and digital dysmorphisms, and progressive skeletal deformations. | Bjoerbaek et al. Diabetes 44: 90–97 (1995). |
| 84 | 30863 | 21988 | insulin-stimulated protein kinase 1 (ISPK-1) | S6K-ALPHA 3; 90 KDA RIBOSOMAL PROTEIN S6 KINASE 3; P90-RSK 3; RIBOSOMAL S6 KINASE 2; RSK-2; PP90RSK2 | U08316 | Phosphorylates a wide range of substrates including ribosomal protein s6. Implicated in the activation of the mitogen-activated kinase cascade. | Defects in rps6ka3 are the cause of coffin-lowry syndrome (cls). The features of this diseases are severe mental retardation with facial and digital dysmorphisms, and progressive skeletal deformations. | Bjoerbaek et al. Diabetes 44: 90–97 (1995). |

TABLE 1-continued

| Nv # | Nv-135619 | Nv-09/724,676 | mRNA | Synonyms | Accession | Function | Potential Diseases | Literature |
|---|---|---|---|---|---|---|---|---|
| 85 | 31044 | 22147 | mitogen-activated kinase kinase kinase 5 (MAPKKK5) | MAPK/ERK KINASE KINASE 5; MEK KINASE 5; MEKK 5; APOPTOSIS SIGNAL-REGULATING KINASE 1; ASK-1 | U67156 | Phosphorylates and activates two different subgroups of map kinase kinases, mkk4/sek1 and mkk3/mapkk6 (or mkk6), which in turn activated stress-activated protein kinase (sapk, also known as jnk; c-jun amino-terminal kinase) and p38 subgroups of map kinases, respectively. Overexpression induces apoptotic cell death. | Genotoxic stress apoptosis (one step of the cascade of activating caspase protease); Apoptosis (sympathetic neurons). | Wang et al. J. Biol. Chem. 271: 31607–31611 (1996). |
| 86 | 6891 28947 | 20594 | TANK binding kinase TBK1 (TBK1) | NF-KB-ACTIVATING KINASE NAK | AF191838 | | | Pomerantz et al. EMBO J. 18: 6694–6704 (1999). |
| 87 | 30263 | 21515 | MAP kinase | STRESS-ACTIVATED PROTEIN KINASE JNK3; C-JUN N-TERMINAL KINASE 3; MAP KINASE P49 3F12 | U07620 | Binds to the amino terminal activation domains of c-jun or atf2 and phosphorylates their regulatory sites (respectively ser-63 and ser-73/thr-69 and thr-71). Also phosphorylates elk1. | | Mohit et al. Neuron 14: 67–78 (1995). |
| 88 | 30270 | 21519 | MAP kinase | STRESS-ACTIVATED PROTEIN KINASE JNK3; C-JUN N-TERMINAL KINASE 3; MAP KINASE P49 3F12 | U07620 | Binds to the amino terminal activation domains of c-jun or atf2 and phosphorylates their regulatory sites (respectively ser-63 and ser-73/thr-69 and thr-71). Also phosphorylates elk1. | | Mohit et al. Neuron 14: 67–78 (1995). |
| 89 | 28197 | 20007 | mRNA for Ndr protein kinase | | Z35102 | Serine(threonine) protein kinase | | Millward et al. Proc Natl Acad Sci U.S.A. May 23, 1995; 92(11): 5022–6. |
| 90 | 28935 | 20592 | Ste-20 related kinase SPAK | | AF099989 | May act as a mediator of stress-activated signals. Belongs to the dck/dgk family | | Johnston et al. Oncogene 19: 4290–4297 (2000). |
| 91 | 28936 | 20593 | Ste-20 related kinase SPAK | | AF099989 | May act as a mediator of stress-activated signals. Belongs to the dck/dgk family | | Johnston et al. Oncogene 19: 4290–4297 (2000). |

The pharmaceutical compositions, whether comprising the nucleic acid sequences of the DNVKs of the invention themselves (alone or in an expression vector), comprising complementary sequences thereto (alone or in an expression vector), comprising the amino acid (products), or alternatively, comprising antibodies to the above, are suitable for the treatment of a plurality of diseases, each one in accordance with the activity of the functional group to which the new DNKV falls as mentioned in Table 1 above.

The detection of diseases utilizing a DNKV probe (comprising the DNKV sequence or a sequence complementary thereto) or alternatively comprising an amino acid sequence reactive with the DNKV product is also in accordance with the functional group to which the DNKVs belong.

Thus, in the above Table 1, there is a brief summary of those conditions, and diseases in which the pharmaceutical composition can treat, i.e. cure, ameliorate or prevent, as well as those conditions which can be detected by DNKV probes of the present invention, or by antibodies reactive with the DNKV product of the invention.

The present invention further concerns any one of SEQ ID NO: 1 to SEQ ID NO: 91 present on a data carrier. The invention further concerns the amino acid sequences present on a data carrier.

The present invention further concerns such a data carrier for use in an analysis of a nucleic acid sequence or amino acid sequence. For the purpose of the analysis said nucleic acid sequence is compared to a sequence of a plurality of nucleic acid sequences being substantially SEQ ID NO: 1 to SEQ ID NO: 91 of which are present on a data carrier or alternatively to the plurality of amino acid sequences present on the carrier. Thus, the data carrier of the invention may be used by others for analysis of nucleic acid sequences which they have, in order to determine whether the sequence they have is a sequence of splice variants of a known gene, obtained through alternative splicing.

This may be done by using a software data combination comprising a nucleotide search and comparison software and a data carrier comprising all of the DNKV sequences of the invention. When the combination is loaded into the computer it can execute a search where a nucleotide sequence entered by the user is compared to the plurality of sequences comprising said data.

The software used for search and comparison between nucleic acid sequences is in combination with the data of the invention, may be any software known in the art for finding homology, at a specified level between an entered nucleic acid sequence and a plurality of nucleic acid sequences present on a data base any person wishing to determine whether a nucleic acid sequence he has is a splice variant of one of the original sequence, may do so by determining whether it appears in one of the sequences of the invention.

The present invention further concerns an inhibitor of kinase activity being any of the amino acid sequences coded by SEQ ID NO: 92 to SEQ ID NO: 182 or fragments thereof.

The present invention also concerns an inhibitor of kinase activity by an isolated nucleic acid sequence being any of the nucleic acid sequences of SEQ ID NO: 1 to SEQ ID NO: 91 and fragments thereof or complementary sequences to any of the above.

BRIEF DESCRIPTION OF THE FIGURES

FIG. 1 shows an alignment between the amino acid sequence of SEQ ID NO. 92 and the amino acid sequence of the counterpart kinase.

FIG. 2 shows an alignment between the amino acid sequence of SEQ ID NO. 93 and the amino acid sequence of the counterpart kinase.

FIG. 3 shows an alignment between the amino acid sequence of SEQ ID NO. 94 and the amino acid sequence of the counterpart kinase.

FIG. 4 shows an alignment between the amino acid sequence of SEQ ID NO. 95 and the amino acid sequence of the counterpart kinase.

FIG. 5 shows an alignment between the amino acid sequence of SEQ ID NO. 96 and the amino acid sequence of the counterpart kinase.

FIG. 6 shows an alignment between the amino acid sequence of SEQ ID NO. 97 and the amino acid sequence of the counterpart kinase.

FIG. 7 shows an alignment between the amino acid sequence of SEQ ID NO. 98 and the amino acid sequence of the counterpart kinase.

FIG. 8 shows an alignment between the amino acid sequence of SEQ ID NO. 99 and the amino acid sequence of the counterpart kinase.

FIG. 9 shows an alignment between the amino acid sequence of SEQ ID NO. 100 and the amino acid sequence of the counterpart kinase.

FIG. 10 shows an alignment between the amino acid sequence of SEQ ID NO. 101 and the amino acid sequence of the counterpart kinase.

FIG. 11 shows an alignment between the amino acid sequence of SEQ ID NO. 102 and the amino acid sequence of the counterpart kinase.

FIG. 12 shows an alignment between the amino acid sequence of SEQ ID NO. 103 and the amino acid sequence of the counterpart kinase.

FIG. 13 shows an alignment between the amino acid sequence of SEQ ID NO. 104 and the amino acid sequence of the counterpart kinase.

FIG. 14 shows an alignment between the amino acid sequence of SEQ ID NO. 105 and the amino acid sequence of the counterpart kinase.

FIG. 15 shows an alignment between the amino acid sequence of SEQ ID NO. 106 and the amino acid sequence of the counterpart kinase.

FIG. 16 shows an alignment between the amino acid sequence of SEQ ID NO. 107 and the amino acid sequence of the counterpart kinase.

FIG. 17 shows an alignment between the amino acid sequence of SEQ ID NO. 108 and the amino acid sequence of the counterpart kinase.

FIG. 18 shows an alignment between the amino acid sequence of SEQ ID NO. 109 and the amino acid sequence of the counterpart kinase.

FIG. 19 shows an alignment between the amino acid sequence of SEQ ID NO. 110 and the amino acid sequence of the counterpart kinase.

FIG. 20 shows an alignment between the amino acid sequence of SEQ ID NO. 111 and the amino acid sequence of the counterpart kinase.

FIG. 21 shows an alignment between the amino acid sequence of SEQ ID NO. 112 and the amino acid sequence of the counterpart kinase.

FIG. 22 shows an alignment between the amino acid sequence of SEQ ID NO. 113 and the amino acid sequence of the counterpart kinase.

FIG. 23 shows an alignment between the amino acid sequence of SEQ ID NO. 114 and the amino acid sequence of the counterpart kinase.

FIG. 24 shows an alignment between the amino acid sequence of SEQ ID NO. 115 and the amino acid sequence of the counterpart kinase.

FIG. 25 shows an alignment between the amino acid sequence of SEQ ID NO. 116 and the amino acid sequence of the counterpart kinase.

FIG. 26 shows an alignment between the amino acid sequence of SEQ ID NO. 117 and the amino acid sequence of the counterpart kinase.

FIG. 27 shows an alignment between the amino acid sequence of SEQ ID NO. 118 and the amino acid sequence of the counterpart kinase.

FIG. 28 shows an alignment between the amino acid sequence of SEQ ID NO. 119 and the amino acid sequence of the counterpart kinase.

FIG. 29 shows an alignment between the amino acid sequence of SEQ ID NO. 120 and the amino acid sequence of the counterpart kinase.

FIG. 30 shows an alignment between the amino acid sequence of SEQ ID NO. 121 and the amino acid sequence of the counterpart kinase.

FIG. 31 shows an alignment between the amino acid sequence of SEQ ID NO. 122 and the amino acid sequence of the counterpart kinase.

FIG. 32 shows an alignment between the amino acid sequence of SEQ ID NO. 123 and the amino acid sequence of the counterpart kinase.

FIG. 33 shows an alignment between the amino acid sequence of SEQ ID NO. 124 and the amino acid sequence of the counterpart kinase.

FIG. 34 shows an alignment between the amino acid sequence of SEQ ID NO. 125 and the amino acid sequence of the counterpart kinase.

FIG. 35 shows an alignment between the amino acid sequence of SEQ ID NO. 126 and the amino acid sequence of the counterpart kinase.

FIG. 36 shows an alignment between the amino acid sequence of SEQ ID NO. 127 and the amino acid sequence of the counterpart kinase.

FIG. 37 shows an alignment between the amino acid sequence of SEQ ID NO. 128 and the amino acid sequence of the counterpart kinase.

FIG. 38 shows an alignment between the amino acid sequence of SEQ ID NO. 129 and the amino acid sequence of the counterpart kinase.

FIG. 39 shows an alignment between the amino acid sequence of SEQ ID NO. 130 and the amino acid sequence of the counterpart kinase.

FIG. 40 shows an alignment between the amino acid sequence of SEQ ID NO. 131 and the amino acid sequence of the counterpart kinase.

FIG. 41 shows an alignment between the amino acid sequence of SEQ ID NO. 132 and the amino acid sequence of the counterpart kinase.

FIG. 42 shows an alignment between the amino acid sequence of SEQ ID NO. 133 and the amino acid sequence of the counterpart kinase.

FIG. 43 shows an alignment between the amino acid sequence of SEQ ID NO. 134 and the amino acid sequence of the counterpart kinase.

FIG. 44 shows an alignment between the amino acid sequence of SEQ ID NO. 135 and the amino acid sequence of the counterpart kinase.

FIG. 45 shows an alignment between the amino acid sequence of SEQ ID NO. 136 and the amino acid sequence of the counterpart kinase.

FIG. 46 shows an alignment between the amino acid sequence of SEQ ID NO. 137 and the amino acid sequence of the counterpart kinase.

FIG. 47 shows an alignment between the amino acid sequence of SEQ ID NO. 138 and the amino acid sequence of the counterpart kinase.

FIG. 48 shows an alignment between the amino acid sequence of SEQ ID NO. 139 and the amino acid sequence of the counterpart kinase.

FIG. 49 shows an alignment between the amino acid sequence of SEQ ID NO. 140 and the amino acid sequence of the counterpart kinase.

FIG. 50 shows an alignment between the amino acid sequence of SEQ ID NO. 141 and the amino acid sequence of the counterpart kinase.

FIG. 51 shows an alignment between the amino acid sequence of SEQ ID NO. 142 and the amino acid sequence of the counterpart kinase.

FIG. 52 shows an alignment between the amino acid sequence of SEQ ID NO. 143 and the amino acid sequence of the counterpart kinase.

FIG. 53 shows an alignment between the amino acid sequence of SEQ ID NO. 144 and the amino acid sequence of the counterpart kinase.

FIG. 54 shows an alignment between the amino acid sequence of SEQ ID NO. 145 and the amino acid sequence of the counterpart kinase.

FIG. 55 shows an alignment between the amino acid sequence of SEQ ID NO. 146 and the amino acid sequence of the counterpart kinase.

FIG. 56 shows an alignment between the amino acid sequence of SEQ ID NO. 147 and the amino acid sequence of the counterpart kinase.

FIG. 57 shows an alignment between the amino acid sequence of SEQ ID NO. 148 and the amino acid sequence of the counterpart kinase.

FIG. 58 shows an alignment between the amino acid sequence of SEQ ID NO. 149 and the amino acid sequence of the counterpart kinase.

FIG. 59 shows an alignment between the amino acid sequence of SEQ ID NO. 150 and the amino acid sequence of the counterpart kinase.

FIG. 60 shows an alignment between the amino acid sequence of SEQ ID NO. 151 and the amino acid sequence of the counterpart kinase.

FIG. 61 shows an alignment between the amino acid sequence of SEQ ID NO. 152 and the amino acid sequence of the counterpart kinase.

FIG. 62 shows an alignment between the amino acid sequence of SEQ ID NO. 153 and the amino acid sequence of the counterpart kinase.

FIG. 63 shows an alignment between the amino acid sequence of SEQ ID NO. 154 and the amino acid sequence of the counterpart kinase.

FIG. 64 shows an alignment between the amino acid sequence of SEQ ID NO. 155 and the amino acid sequence of the counterpart kinase.

FIG. 65 shows an alignment between the amino acid sequence of SEQ ID NO. 156 and the amino acid sequence of the counterpart kinase.

FIG. 66 shows an alignment between the amino acid sequence of SEQ ID NO. 157 and the amino acid sequence of the counterpart kinase.

FIG. 67 shows an alignment between the amino acid sequence of SEQ ID NO. 158 and the amino acid sequence of the counterpart kinase.

FIG. 68 shows an alignment between the amino acid sequence of SEQ ID NO. 159 and the amino acid sequence of the counterpart kinase.

FIG. 69 shows an alignment between the amino acid sequence of SEQ ID NO. 160 and the amino acid sequence of the counterpart kinase.

FIG. 70 shows an alignment between the amino acid sequence of SEQ ID NO. 161 and the amino acid sequence of the counterpart kinase.

FIG. 71 shows an alignment between the amino acid sequence of SEQ ID NO. 162 and the amino acid sequence of the counterpart kinase.

FIG. 72 shows an alignment between the amino acid sequence of SEQ ID NO. 163 and the amino acid sequence of the counterpart kinase.

FIG. 73 shows an alignment between the amino acid sequence of SEQ ID NO. 164 and the amino acid sequence of the counterpart kinase.

FIG. 74 shows an alignment between the amino acid sequence of SEQ ID NO. 165 and the amino acid sequence of the counterpart kinase.

FIG. 75 shows an alignment between the amino acid sequence of SEQ ID NO. 166 and the amino acid sequence of the counterpart kinase.

FIG. 76 shows an alignment between the amino acid sequence of SEQ ID NO. 167 and the amino acid sequence of the counterpart kinase.

FIG. 77 shows an alignment between the amino acid sequence of SEQ ID NO. 168 and the amino acid sequence of the counterpart kinase.

FIG. 78 shows an alignment between the amino acid sequence of SEQ ID NO. 169 and the amino acid sequence of the counterpart kinase.

FIG. 79 shows an alignment between the amino acid sequence of SEQ ID NO. 170 and the amino acid sequence of the counterpart kinase.

FIG. 80 shows an alignment between the amino acid sequence of SEQ ID NO. 171 and the amino acid sequence of the counterpart kinase.

FIG. 81 shows an alignment between the amino acid sequence of SEQ ID NO. 172 and the amino acid sequence of the counterpart kinase.

FIG. 82 shows an alignment between the amino acid sequence of SEQ ID NO. 173 and the amino acid sequence of the counterpart kinase.

FIG. 83 shows an alignment between the amino acid sequence of SEQ ID NO. 174 and the amino acid sequence of the counterpart kinase.

FIG. 84 shows an alignment between the amino acid sequence of SEQ ID NO. 175 and the amino acid sequence of the counterpart kinase.

FIG. 85 shows an alignment between the amino acid sequence of SEQ ID NO. 176 and the amino acid sequence of the counterpart kinase.

FIG. 86 shows an alignment between the amino acid sequence of SEQ ID NO. 177 and the amino acid sequence of the counterpart kinase.

FIG. 87 shows an alignment between the amino acid sequence of SEQ ID NO. 178 and the amino acid sequence of the counterpart kinase.

FIG. 88 shows an alignment between the amino acid sequence of SEQ ID NO. 179 and the amino acid sequence of the counterpart kinase.

FIG. 89 shows an alignment between the amino acid sequence of SEQ ID NO. 180 and the amino acid sequence of the counterpart kinase.

FIG. 90 shows an alignment between the amino acid sequence of SEQ ID NO. 181 and the amino acid sequence of the counterpart kinase.

FIG. 91 shows an alignment between the amino acid sequence of SEQ ID NO. 182 and the amino acid sequence of the counterpart kinase.

SEQ ID NOs: are assigned to the sequences as described below:

SEQ ID NO: 1–91 refers to the nucleotide sequences of Dominant Negative Kinase variant (DNKV) sequences as described in the specification.

SEQ ID NO: 92–182 refers to the amino acid sequences of Dominant Negative Kinase Variant (DNKV) sequences as described in the specification and depicted in FIGS. 1–91.

SEQ ID NO: 183–271 refers to the amino acid sequences of the counterpart kinases from SEQ ID 92–182 respectively as described in the specification and depicted in FIGS. 1–91;

DETAILED DESCRIPTION OF PREFERRED EMBODIMENTS

EXAMPLE 1

DNKV Nucleic Acid Sequence

The nucleic acid sequences of the invention include nucleic acid sequences which encode DNKV product and fragments and analogs thereof. The nucleic acid sequences may alternatively be sequences complementary to the above coding sequence, or to a region of said coding sequence. The length of the complementary sequence is sufficient to avoid the expression of the coding sequence. The nucleic acid sequences may be in the form of RNA or in the form of DNA, and include messenger RNA, synthetic RNA and DNA, cDNA, and genomic DNA. The DNA may be double-stranded or single-stranded, and if single-stranded may be the coding strand or the non-coding (anti-sense, complementary) strand. The nucleic acid sequences may also both include dNTPs, rNTPs as well as non naturally occurring sequences. The sequence may also be a part of a hybrid between an amino acid sequence and a nucleic acid sequence.

In a general embodiment, the nucleic acid sequence has at least 90%, identity, preferably 95% with any one of the sequence identified as SEQ ID NO: 1 to SEQ ID NO: 91 provided that this sequence is not completely identical with that of the original sequence.

The nucleic acid sequences may include the coding sequence by itself. By another alternative the coding region may be in combination with additional coding sequences, such as those coding for fusion protein or signal peptides, in combination with non-coding sequences, such as introns and control elements, promoter and terminator elements or 5' and/or 3' untranslated regions, effective for expression of the coding sequence in a suitable host, and/or in a V actor or host environment in which the DNKV nucleic acid sequence is introduced as a heterologous sequence.

The nucleic acid sequences of the present invention may also have the product coding sequence fused in-frame to a marker sequence which allows for purification of the DNKV product. The marker sequence may be, for example, a hexahistidine tag to provide for purification of the mature polypeptide fused to the marker in the case of a bacterial host, or, the marker sequence may be a hemagglutinin (HA) tag when a mammalian host, e.g. COS-7 cells, is used. The HA tag corresponds to an epitope derived from the influenza hemagglutinin protein (Wilson, I., et al. *Cell* 37:767 (1984)).

Also included in the scope of the invention are fragments as defined above also referred to herein as oligonucleotides, typically having at least 20 bases, preferably 20–30 bases corresponding to a region of the coding-sequence nucleic acid sequence. The fragments may be used as probes, primers, and when complementary also as antisense agents, and the like, according to known methods.

As indicated above, the nucleic acid sequence may be substantially a depicted in any one of SEQ ID NO: 1 to SEQ ID NO: 91 or fragments thereof or sequences having at least 90% identity to the above sequence as explained above. Alternatively, due to the degenerative nature of the genetic code, the sequence may be a sequence coding for any one of the amino acid sequence depicted in SEQ ID NO: 92 to SEQ ID NO: 182, or fragments or analogs of said amino acid sequence.

A. Preparation of Nucleic Acid Sequences The nucleic acid sequences may be obtained by screening cDNA libraries using oligonucleotide probes which can hybridize to or PCR-amplify nucleic acid sequences which encode the DNKV products disclosed above. cDNA libraries prepared from a variety of tissues are commercially available and procedures for screening and isolating cDNA clones are well-known to those of skill in the art. Such techniques are described in, for example, Sambrook et al. (1989) Molecular Cloning: A Laboratory Manual (2nd Edition), Cold Spring Harbor Press, Plainview, N.Y. and Ausubel F M et al. (1989) Current Protocols in Molecular Biology, John Wiley & Sons, New York, N.Y.

The nucleic acid sequences may be extended to obtain upstream and downstream sequences such as promoters, regulatory elements, and 5' and 3' untranslated regions (UTRs). Extension of the available transcript sequence may be performed by numerous methods known to those of skill in the art, such as PCR or primer extension (Sambrook et al., supra), or by the RACE method using, for example, the Marathon RACE kit (Clontech, Cat. # K1802-1).

Alternatively, the technique of "restriction-site" PCR (Gobinda et al. *PCR Methods Applic.* 2:318–22, (1993)), which uses universal primers to retrieve flanking sequence adjacent a known locus, may be employed. First, genomic DNA is amplified in the presence of primer to a linker sequence and a primer specific to the known region. The amplified sequences are subjected to a second round of PCR with the same linker primer and another specific primer internal to the first one. Products of each round of PCR are transcribed with an appropriate RNA polymerase and sequenced using reverse transcriptase.

Inverse PCR can be used to amplify or extend sequences using divergent primers based on a known region (Triglia, T. et al., *Nucleic Acids Res.* 16:8186, (1988)). The primers may be designed using OLIGO(R) 4.06 Primer Analysis Software (1992; National Biosciences Inc, Plymouth, Minn.), or another appropriate program, to be 22–30 nucleotides in length, to have a GC content of 50% or more, and to anneal to the target sequence at temperatures about 68–72° C. The method uses several restriction enzymes to generate a suitable fragment in the known region of a gene. The fragment is then circularized by intramolecular ligation and used as a PCR template.

Capture PCR (Lagerstrom, M. et al., *PCR Methods Applic.* 1:111–19, (1991)) is a method for PCR amplification of DNA fragments adjacent to a known sequence in human and yeast artificial chromosome DNA. Capture PCR also requires multiple restriction enzyme digestions and ligations to place an engineered double-stranded sequence into a flanking part of the DNA molecule before PCR.

Another method which may be used to retrieve flanking sequences is that of Parker, J. D., et al., *Nucleic Acids Res.,* 19:3055–60, (1991)). Additionally, one can use PCR, nested primers and PromoterFinder™ libraries to "walk in" genomic DNA (PromoterFinder™; Clontech, Palo Alto, Calif.). This process avoids the need to screen libraries and is useful in finding intron/exon junctions. Preferred libraries for screening for full length cDNAs are ones that have been size-selected to include larger cDNAs. Also, random primed libraries are preferred in that they will contain more sequences which contain the 5' and upstream regions of genes.

A randomly primed library may be particularly useful if an oligo d(T) library does not yield a full-length cDNA. Genomic libraries are useful for extension into the 5' non-translated regulatory region.

The nucleic acid sequences and oligonucleotides of the invention can also be prepared by solid-phase methods, according to known synthetic methods. Typically, fragments of up to about 100 bases are individually synthesized, then joined to form continuous sequences up to several hundred bases.

B. Use of DNKV Nucleic Acid Sequence for the Production of DNKV Products

In accordance with the present invention, nucleic acid sequences specified above may be used as recombinant DNA molecules that direct the expression of DNKV products.

As will be understood by those of skill in the art, it may be advantageous to produce DNKV product-encoding nucleotide sequences possessing codons other than those which appear in any one of SEQ ID NO: 1 to SEQ ID NO: 91 which are those which naturally occur in the human genome. Codons preferred by a particular prokaryotic or eukaryotic host (Murray, E. et al. *Nuc Acids Res.,* 17:477–508, (1989)) can be selected, for example, to increase the rate of DNKV product expression or to produce recombinant RNA transcripts having desirable properties, such as a longer half-life, than transcripts produced from naturally occurring sequence.

The nucleic acid sequences of the present invention can be engineered in order to alter a DNKV product coding sequence for a variety of reasons, including but not limited to, alterations which modify the cloning, processing and/or expression of the product. For example, alterations may be introduced using techniques which are well known in the art, e.g., site-directed mutagenesis, to insert new restriction sites, to alter glycosylation patterns, to change codon preference, etc.

The present invention also includes recombinant constructs comprising one or more of the sequences as broadly described above. The constructs comprise a vector, such as a plasmid or viral vector, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available. Appropriate cloning and expression vectors for use with prokaryotic and eukaryotic hosts are also described in Sambrook, et al., (supra).

The present invention also relates to host cells which are genetically engineered with vectors of the invention, and the production of the product of the invention by recombinant techniques. Host cells are genetically engineered (i.e., transduced, transformed or transfected) with the vectors of this invention which may be, for example, a cloning vector or an expression vector. The vector may be, for example, in the form of a plasmid, a viral particle, a phage, etc. The engineered host cells can be cultured in conventional nutrient media modified as appropriate for activating promoters, selecting transformants or amplifying the expression of the DNKV nucleic acid sequence. The culture conditions, such as temperature, pH and the like, are those previously used with the host cell selected for expression, and will be apparent to those skilled in the art.

The nucleic acid sequences of the present invention may be included in any one of a variety of expression vectors for expressing a product. Such vectors include chromosomal, nonchromosomal and synthetic DNA sequences, e.g., derivatives of SV40; bacterial plasmids; phage DNA; baculovirus; yeast plasmids; vectors derived from combinations of plasmids and phage DNA, viral DNA such as vaccinia, adenovirus, fowl pox virus, and pseudorabies. However, any other vector may be used as long as it is replicable and viable in the host. The appropriate DNA sequence may be inserted into the vector by a variety of procedures. In general, the DNA sequence is inserted into an appropriate restriction endonuclease site(s) by procedures known in the art. Such procedures and related sub-cloning procedures are deemed to be within the scope of those skilled in the art.

The DNA sequence in the expression vector is operatively linked to an appropriate transcription control sequence (promoter) to direct mRNA synthesis. Examples of such promoters include: LTR or SV40 promoter, the *E. coli* lac or trp promoter, the phage lambda PL promoter, and other promoters known to control expression of genes in prokaryotic or eukaryotic cells or their viruses. The expression vector also contains a ribosome binding site for translation initiation, and a transcription terminator. The vector may also include appropriate sequences for amplifying expression. In addition, the expression vectors preferably contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

The vector containing the appropriate DNA sequence as described above, as well as an appropriate promoter or control sequence, may be employed to transform an appropriate host to permit the host to express the protein. Examples of appropriate expression hosts include: bacterial cells, such as *E. coli, Streptomyces, Salmonella typhimurium*; fungal cells, such as yeast; insect cells such as *Drosophila* and *Spodoptera* Sf9; animal cells such as CHO, COS, HEK 293 or Bowes melanoma; adenoviruses; plant cells, etc. The selection of an appropriate host is deemed to be within the scope of those skilled in the art from the teachings herein. The invention is not limited by the host cells employed.

In bacterial systems, a number of expression vectors may be selected depending upon the use intended for the DNKV product. For example, when large quantities of DNKV product are needed for the induction of antibodies, vectors which direct high level expression of fusion proteins that are readily purified may be desirable. Such vectors include, but are not limited to, multifunctional *E. coli* cloning and expression vectors such as Bluescript(R) (Stratagene), in which the DNKV polypeptide coding sequence may be ligated into the vector in-frame with sequences for the amino-terminal Met and the subsequent 7 residues of beta-galactosidase so that a hybrid protein is produced; pIN vectors (Van Heeke & Schuster *J. Biol. Chem.* 264:5503–5509, (1989)); pET vectors (Novagen, Madison Wis.); and the like.

In the yeast *Saccharomyces cerevisiae* a number of vectors containing constitutive or inducible promoters such as alpha factor, alcohol oxidase and PGH may be used. For reviews, see Ausubel et al. (supra) and arrant et al., (*Methods in Enzymology* 153:516–544, (1987)).

In cases where plant expression vectors are used, the expression of a sequence encoding DNKV product may be driven by any of a number of promoters. For example, viral promoters such as the 35S and 19S promoters of CaMV (Brisson et al., *Nature* 310:511–514. (1984)) may be used alone or in combination with the omega leader sequence from TMV (Takamatsu et al., *EMBO J.,* 6:307–311, (1987)). Alternatively, plant promoters such as the small subunit of RUBISCO (Coruzzi et al., *EMBO J.* 3:1671–1680, (1984); Broglie et al., *Science* 224:838–843, (1984)); or heat shock promoters (Winter J and Sinibaldi R. M., *Results Probl. Cell Differ.,* 17:85–105, (1991)) may be used. These constructs can be introduced into plant cells by direct DNA transformation or pathogen-mediated transfection. For reviews of such techniques, see Hobbs S. or Murry L. E. (1992) in McGraw Hill Yearbook of Science and Technology, McGraw Hill, New York, N.Y., pp 191–196; or Weissbach and Weissbach (1988) *Methods for Plant Molecular Biology*, Academic Press, New York, N.Y., pp 421–463.

DNKV product may also be expressed in an insect system. In one such system, *Autographa californica* nuclear polyhedrosis virus (AcNPV) is used as a vector to express foreign genes in *Spodoptera frugiperda* cells or in *Trichoplusia* larvae. The DNKV product coding sequence may be cloned into a nonessential region of the virus, such as the polyhedrin gene, and placed under control of the polyhedrin promoter. Successful insertion of DNKV coding sequence will render the polyhedrin gene inactive and produce recombinant virus lacking coat protein coat. The recombinant viruses are then used to infect *S. frugiperda* cells or *Trichoplusia* larvae in which DNKV protein is expressed (Smith et al., *J. Virol.* 46:584, (1983); Engelhard, E. K. et al., *Proc. Nat. Acad. Sci.* 91:3224–7, (1994)).

In mammalian host cells, a number of viral-based expression systems may be utilized. In cases where an adenovirus is used as an expression vector, a DNKV product coding sequence may be ligated into an adenovirus transcription/translation complex consisting of the late promoter and tripartite leader sequence. Insertion in a nonessential E1 or E3 region of the viral genome will result in a viable virus capable of expressing DNKV protein in infected host cells (Logan and Shenk, *Proc. Natl. Acad. Sci.* 81:3655–59, (1984). In addition, transcription enhancers, such as the Rous sarcoma virus (RSV) enhancer, may be used to increase expression in mammalian host cells.

Specific initiation signals may also be required for efficient translation of a DNKV product coding sequence. These signals include the ATG initiation codon and adjacent sequences. In cases where DNKV product coding sequence, its initiation codon and upstream sequences are inserted into the appropriate expression vector, no additional translational control signals may be needed. However, in cases where only coding sequence, or a portion thereof, is inserted, exogenous transcriptional control signals including the ATG initiation codon must be provided. Furthermore, the initiation codon must be in the correct reading frame to ensure transcription of the entire insert. Exogenous transcriptional elements and initiation codons can be of various origins, both natural and synthetic. The efficiency of expression may be enhanced by the inclusion of enhancers appropriate to the cell system in use (Scharf, D. et al., (1994) *Results Probl. Cell Differ.,* 20:125–62, (1994); Bittner et al., *Methods in Enzymol* 153:516–544, (1987)).

In a further embodiment, the present invention relates to host cells containing the above-described constructs. The host cell can be a higher eukaryotic cell, such as a mammalian cell, or a lower eukaryotic cell, such as a yeast cell, or the host cell can be a prokaryotic cell, such as a bacterial cell. Introduction of the construct into the host cell can be effected by calcium phosphate transfection, DEAE-Dextran mediated transfection, or electroporation (Davis, L., Dibner, M., and Battey, I. (1986) Basic Methods in Molecular Biology). Cell-free translation systems can also be employed to produce polypeptides using RNAs derived from the DNA constructs of the present invention.

A host cell strain may be chosen for its ability to modulate the expression of the inserted sequences or to process the expressed protein in the desired fashion. Such modifications of the protein include, but are not limited to, acetylation, carboxylation, glycosylation, phosphorylation, lipidation and acylation. Post-translational processing which cleaves a "pre-pro" form of the protein may also be important for correct insertion, folding and/or function. Different host cells such as CHO, HeLa, MDCK, 293, WI38, etc. have specific cellular machinery and characteristic mechanisms for such post-translational activities and may be chosen to ensure the correct modification and processing of the introduced, foreign protein.

For long-term, high-yield production of recombinant proteins, stable expression is preferred. For example, cell lines which stably express DNKV product may be transformed using expression vectors which contain viral origins of replication or endogenous expression elements and a selectable marker gene. Following the introduction of the vector, cells may be allowed to grow for 1–2 days in an enriched media before they are switched to selective media. The purpose of the selectable marker is to confer resistance to selection, and its presence allows growth and recovery of cells which successfully express the introduced sequences. Resistant clumps of stably transformed cells can be proliferated using tissue culture techniques appropriate to the cell type.

Any number of selection systems may be used to recover transformed cell lines. These include, but are not limited to, the herpes simplex virus thymidine kinase (Wigler M., et al., *Cell* 11:223–32, (1977)) and adenine phosphoribosyltransferase (Lowy I., et al., *Cell* 22:817–23, (1980)) genes which can be employed in tk- or aprt-cells, respectively. Also, antimetabolite, antibiotic or herbicide resistance can be used as the basis for selection; for example, dhfr which confers resistance to methotrexate (Wigler M., et al., *Proc. Natl. Acad. Sci.* 77:3567–70, (1980)); npt, which confers resistance to the aminoglycosides neomycin and G-418 (Colbere-Garapin, F. et al., *J. Mol. Biol.,* 150:1–14, (1981)) and als or pat, which confer resistance to chlorsulfuron and phosphinotricin acetyltransferase, respectively (Murry, supra). Additional selectable genes have been described, for example, trpB, which allows cells to utilize indole in place of tryptophan, or hisD, which allows cells to utilize histinol in place of histidine (Hartman S. C. and R. C. Mulligan, *Proc. Natl. Acad. Sci.* 85:8047–51, (1988)). The use of visible markers has gained popularity with such markers as anthocyanins, beta-glucuronidase and its substrate, GUS, and luciferase and its substrates, luciferin and ATP, being widely used not only to identify transformants, but also to quantify the amount of transient or stable protein expression attributable to a specific vector system (Rhodes, C. A. et. al., *Methods Mol. Biol.,* 55:121–131, (1995)).

Host cells transformed with a nucleotide sequence encoding DNKV product may be cultured under conditions suitable for the expression and recovery of the encoded protein from cell culture. The product produced by a recombinant cell may be secreted or contained intracellularly depending on the sequence and/or the vector used. As will be understood by those of skill in the art, expression vectors containing nucleic acid sequences encoding DNKV product can be designed with signal sequences which direct secretion of DNKV product through a prokaryotic or eukaryotic cell membrane.

The DNKV product may also be expressed as a recombinant protein with one or more additional polypeptide domains added to facilitate protein purification. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp, Seattle, Wash.). The inclusion of a protease-cleavable polypeptide linker sequence between the purification domain and DNKV product is useful to facilitate purification. One such expression vector provides for expression of a fusion protein compromising a DNKV polypeptide fused to a polyhistidine region separated by an enterokinase cleavage site. The histidine residues facilitate purification on IMIAC (immobilized metal ion affinity chromatography, as described in Porath, et al., *Protein Expression and Purification,* 3:263–281, (1992)) while the enterokinase cleavage site provides a means for isolating DNKV polypeptide from the fusion protein. pGEX vectors (Promega, Madison, Wis.) may also be used to express foreign polypeptides as fusion proteins with glutathione S-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

Following transformation of a suitable host strain and growth of the host strain to an appropriate cell density, the selected promoter is induced by appropriate means (e.g., temperature shift or chemical induction) and cells are cultured for an additional period. Cells are typically harvested by centrifugation, disrupted by physical or chemical means, and the resulting crude extract retained for further purification. Microbial cells employed in expression of proteins can be disrupted by any convenient method, including freeze-thaw cycling, sonication, mechanical disruption, or use of cell lysing agents, or other methods, which are well know to those skilled in the art.

The DNKV products can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, affinity chromatography, hydroxylapatite chromatography, and lectin chromatography. Protein refolding steps can be used, as necessary, in completing configuration of the mature protein. Finally, high performance liquid chromatography (HPLC) can be employed for final purification steps.

C. Diagnostic Applications Utilizing Nucleic Acid Sequences

The nucleic acid sequences of the present invention may be used for a variety of diagnostic purposes. The nucleic acid sequences may be used to detect and quantitate expression of the DNKV in patient's cells, e.g. biopsied tissues, by detecting the presence of mRNA coding for DNKV product. Alternatively, the assay may be used to detect soluble DNKV in the serum or blood. This assay typically involves obtaining total mRNA from the tissue or serum and contacting the mRNA with a nucleic acid probe. The probe is a nucleic acid molecule of at least 20 nucleotides, preferably 20–30 nucleotides, capable of specifically hybridizing with a sequence included within the sequence of a nucleic acid molecule encoding DNKV product under hybridizing conditions, detecting the presence of mRNA hybridized to the probe, and thereby detecting the expression of DNKV. This assay can be used to distinguish between absence, presence, and excess expression of DNKV product and to monitor levels of DNKV expression during therapeutic intervention. In addition, the assay may be used to compare the levels of the DNKV of the invention to the levels of the original kinase sequence from which it has been varied or to levels of other DNKVs, which comparison may have some physiological meaning.

The invention also contemplates the use of the nucleic acid sequences as a diagnostic for diseases resulting from inherited defective DNKV sequences, or diseases in which the ratio of the amount of the original kinase sequence from which the DNKV was varied to the novel DNKVs of the invention is altered. These sequences can be detected by comparing the sequences of the defective (i.e., mutant) DNKV coding region with that of a normal coding region. Association of the sequence coding for mutant DNKV product with abnormal DNKV product activity may be verified. In addition, sequences encoding mutant DNKV products can be inserted into a suitable vector for expression in a functional assay system (e.g., calorimetric assay, complementation experiments in a variant protein deficient strain of HEK293 cells) as yet another means to verify or identify mutations. Once mutant genes have been identified, one can then screen populations of interest for carriers of the mutant gene.

Individuals carrying mutations in the nucleic acid sequence of the present invention may be detected at the DNA level by a variety of techniques. Nucleic acids used for diagnosis may be obtained from a patient's cells, including but not limited to such as from blood, urine, saliva, placenta, tissue biopsy and autopsy material. Genomic DNA may be used directly for detection or may be amplified enzymatically by using PCR (Saiki, et al., *Nature* 324:163–166, (1986)) prior to analysis. RNA or cDNA may also be used for the same purpose. As an example, PCR primers complementary to the nucleic acid of the present invention can be used to identify and analyze mutations in the gene of the present invention. Deletions and insertions can be detected by a change in size of the amplified product in comparison to the normal genotype.

Point mutations can be identified by hybridizing amplified DNA to radiolabeled RNA of the invention or alternatively, radiolabeled antisense DNA sequences of the invention. Sequence changes at specific locations may also be revealed by nuclease protection assays, such RNase and S1 protection or the chemical cleavage method (e.g. Cotton, et al *Proc. Natl. Acad. Sci. USA*, 85:4397–4401, (1985)), or by differences in melting temperatures. "Molecular beacons" (Kostrikis L. G. et al., *Science* 279:1228–1229, (1998)), hairpin-shaped, single-stranded synthetic oligo-nucleotides containing probe sequences which are complementary to the nucleic acid of the present invention, may also be used to detect point mutations or other sequence changes as well as monitor expression levels of DNKV product. Such diagnostics would be particularly useful for prenatal testing.

Another method for detecting mutations uses two DNA probes which are designed to hybridize to adjacent regions of a target, with abutting bases, where the region of known or suspected mutation(s) is at or near the abutting bases. The two probes may be joined at the abutting bases, e.g., in the presence of a ligase enzyme, but only if both probes are correctly base paired in the region of probe junction. The presence or absence of mutations is then detectable by the presence or absence of ligated probe.

Also suitable for detecting mutations in the DNKV product coding sequence are oligonucleotide array methods based on sequencing by hybridization (SBH), as described, for example, in U.S. Pat. No. 5,547,839. In a typical method, the DNA target analyte is hybridized with an array of oligonucleotides formed on a microchip. The sequence of the target can then be "read" from the pattern of target binding to the array.

D. Gene Mapping Utilizing Nucleic Acid Sequences

The nucleic acid sequences of the present invention are also valuable for chromosome identification. The sequence is specifically targeted to and can hybridize with a particular location on an individual human chromosome. Moreover, there is a current need for identifying particular sites on the chromosome. Few chromosome marking reagents based on actual sequence data (repeat polymorphisms) are presently available for marking chromosomal location. The mapping of DNAs to chromosomes according to the present invention is an important first step in correlating those sequences with genes associated with disease.

Briefly, sequences can be mapped to chromosomes by preparing PCR primers (preferably 20–30 bp) from the DNKV cDNA. Computer analysis of the 3' untranslated region is used to rapidly select primers that do not span more than one exon in the genomic DNA, which would complicate the amplification process. These primers are then used for PCR screening of somatic cell hybrids containing individual human chromosomes. Only those hybrids containing the human gene corresponding to the primer will yield an amplified fragment.

PCR mapping of somatic cell hybrids or using instead radiation hybrids are rapid procedures for assigning a particular DNA to a particular chromosome. Using the present invention with the same oligonucleotide primers, sublocalization can be achieved with panels of fragments from specific chromosomes or pools of large genomic clones in an analogous manner. Other mapping strategies that can similarly be used to map to its chromosome include in situ hybridization, prescreening with labeled flow-sorted chromosomes and preselection by hybridization to construct chromosome specific-cDNA libraries.

Fluorescence in situ hybridization (FISH) of a cDNA clone to a metaphase chromosomal spread can be used to provide a precise chromosomal location in one step. This technique can be used with cDNA as short as 50 or 60 bases. For a review of this technique, see Verma et al., *Human Chromosomes: a Manual of Basic Techniques*, (1988) Pergamon Press, New York.

Once a sequence has been mapped to a precise chromosomal location, the physical position of the sequence on the chromosome can be correlated with genetic map data. Such data are found, for example, in the OMIM database (Center for Medical Genetics, Johns Hopkins University, Baltimore, Md. and National Center for Biotechnology Information, National Library of Medicine, Bethesda, Md.). The OMIM gene map presents the cytogenetic map location of disease genes and other expressed genes. The OMIM database provides information on diseases associated with the chromosomal location. Such associations include the results of linkage analysis mapped to this interval, and the correlation of translocations and other chromosomal aberrations in this area with the advent of polygenic diseases, such as cancer, in general and prostate cancer in particular.

E. Therapeutic Applications of Nucleic Acid Sequences

Nucleic acid sequences of the invention may also be used for therapeutic purposes. Turning first to the second aspect of the invention (i.e. inhibition of expression of DNKV), expression of DNKV product may be modulated through antisense technology, which controls gene expression through hybridization of complementary nucleic acid sequences, i.e. antisense DNA or RNA, to the control, 5' or coding regions of the gene encoding DNKV product. For example, the 5' coding portion of the nucleic acid sequence which codes for the product of the present invention is used to design an antisense oligonucleotide of from about 10 to 40 base pairs in length. Oligonucleotides derived from the transcription start site, e.g. between positions −10 and +10 from the start site, are preferred. An antisense DNA oligonucleotide is designed to be complementary to a region of the nucleic acid sequence involved in transcription (Lee et al., *Nucl. Acids, Res.*, 6:3073, (1979); Cooney et al., *Science* 241:456, (1988); and Dervan et al., *Science* 251:1360, (1991)), thereby preventing transcription and the production of the DNKV products. An antisense RNA oligonucleotide hybridizes to the mRNA in vivo and blocks translation of the mRNA molecule into the DNKV products (Okano *J. Neurochem.* 56:560, (1991)). The antisense constructs can be delivered to cells by procedures known in the art such that the antisense RNA or DNA may be expressed in vivo. The antisense may be antisense mRNA or DNA sequence capable of coding such antisense mRNA. The antisense mRNA or the DNA coding thereof can be complementary to the full sequence of nucleic acid sequences coding for the DNKV protein or to a fragment of such a sequence which is sufficient to inhibit production of a protein product.

Turning now to the first aspect of the invention, i.e. expression of DNKV, expression of DNKV product may be increased by providing coding sequences for coding for said product under the control of suitable control elements ending its expression in the desired host.

The nucleic acid sequences of the invention may be employed in combination with a suitable pharmaceutical carrier. Such compositions comprise a therapeutically effective amount of the compound, and a pharmaceutically acceptable carrier or excipient. Such a carrier includes but is not limited to saline, buffered saline, dextrose, water, glycerol, ethanol, and combinations thereof. The formulation should suit the mode of administration.

The products of the invention as well as any activators and deactivators compounds (see below) which are polypeptides, may also be employed in accordance with the present invention by expression of such polypeptides in vivo, which is often referred to as "gene therapy." Cells from a patient may be engineered with a nucleic acid sequence (DNA or RNA) encoding a polypeptide ex vivo, with the engineered cells then being provided to a patient to be treated with the polypeptide. Such methods are well-known in the art. For example, cells may be engineered by procedures known in the art by use of a retroviral particle containing RNA encoding a polypeptide of the present invention.

Similarly, cells may be engineered in vivo for expression of a polypeptide in vivo by procedures known in the art. As known in the art, a producer cell for producing a retroviral particle containing RNA encoding the polypeptide of the present invention may be administered to a patient for engineering cells in vivo and expression of the polypeptide in vivo. These and other methods for administering a product of the present invention by such method should be apparent to those skilled in the art from the teachings of the present invention. For example, the expression vehicle for engineering cells may be other than a retrovirus, for example, an adenovirus which may be used to engineer cells in vivo after combination with a suitable delivery vehicle.

Retroviruses from which the retroviral plasmid vectors mentioned above may be derived include, but are not limited to, Moloney Murine Leukemia Virus, spleen necrosis virus, retroviruses such as Rous Sarcoma Virus, Harvey Sarcoma Virus, avian leukosis virus, gibbon ape leukemia virus, human immunodeficiency virus, adenovirus, Myeloproliferative Sarcoma Virus, and mammary tumor virus.

The retroviral plasmid vector is employed to transduce packaging cell lines to form producer cell lines. Examples of packaging cells which may be transfected include, but are not limited to, the PE501, PA317, psi-2, psi-AM, PA12, T19-14X, VT-19-17-H2, psi-CRE, psi-CRIP, GP+E-86, GP+envAm12, and DAN cell lines as described in Miller (*Human Gene Therapy*, Vol. 1, pg. 5–14, (1990)). The vector may transduce the packaging cells through any means known in the art. Such means include, but are not limited to, electroporation, the use of liposomes, and $CaPO_4$ precipitation. In one alternative, the retroviral plasmid vector may be encapsulated into a liposome, or coupled to a lipid, and then administered to a host.

The producer cell line generates infectious retroviral vector particles which include the nucleic acid sequence(s) encoding the polypeptides. Such retroviral vector particles then may be employed, to transduce eukaryotic cells, either in vitro or in vivo. The transduced eukaryotic cells will express the nucleic acid sequence(s) encoding the polypeptide. Eukaryotic cells which may be transduced include, but are not limited to, embryonic stem cells, embryonic carcinoma cells, as well as hematopoietic stem cells, hepatocytes, fibroblasts, myoblasts, keratinocytes, endothelial cells, and bronchial epithelial cells.

The genes introduced into cells may be placed under the control of inducible promoters, such as the radiation-inducible Egr-1 promoter, (Maceri, H. J., et al., *Cancer Res.*, 56(19):4311 (1996)), to stimulate DNKV production or antisense inhibition in response to radiation, e.g., radiation therapy for treating tumors.

EXAMPLE II

DNKV Product

The substantially purified DNKV product of the invention has been defined above as the product coded from the nucleic acid sequence of the invention. Preferably the amino acid sequence is an amino acid sequence having at least 90% identity to any one of the sequences coded by the nucleic acid sequence of SEQ ID NO: 1 to SEQ ID NO: 91 provided that the amino acid sequence is not identical to that of the original sequence from which it has been varied. The protein or polypeptide may be in mature and/or modified form, also as defined above. Also contemplated are protein fragments having at least 10 contiguous amino acid residues, preferably at least 10–20 residues, derived from the DNKV product, as well as homologues as explained above.

The sequence variations are preferably those that are considered conserved substitutions, as defined above. Thus, for example, a protein with a sequence having at least 90% sequence identity with any of the products depicted by SEQ ID NO: 92 to SEQ ID NO: 182, preferably by utilizing conserved substitutions as defined above is also part of the invention, and provided that it is not identical to the original peptide from which it has been varied. The DNKV product may be (i) one in which one or more of the amino acid residues in a sequence listed above are substituted with a conserved or non-conserved amino acid residue (preferably a conserved amino acid residue), or (ii) one in which one or more of the amino acid residues includes a substituent group, or (iii) one in which the DNKV product is fused with another compound, such as a compound to increase the half-life of the protein (for example, polyethylene glycol (PEG)), or a moiety which serves as targeting means to direct the protein to its target tissue or target cell population (such as an antibody), or (iv) one in which additional amino acids are fused to the DNKV product. Such fragments, DNKVS and derivatives are deemed to be within the scope of those skilled in the art from the teachings herein.

A. Preparation of DNKV Product

Recombinant methods for producing and isolating the DNKV product, and fragments of the protein are described above.

In addition to recombinant production, fragments and portions of DNKV product may be produced by direct peptide synthesis using solid-phase techniques (cf. Stewart et al., (1969) Solid-Phase Peptide Synthesis, WH Freeman Co, San Francisco; Merrifield J., *J. Am. Chem. Soc.*, 85:2149–2154, (1963)). In vitro peptide synthesis may be performed using manual techniques or by automation. Automated synthesis may be achieved, for example, using Applied Biosystems 431A Peptide Synthesizer (Perkin Elmer, Foster City, Calif.) in accordance with the instructions provided by the manufacturer. Fragments of DNKV product may be chemically synthesized separately and combined using chemical methods to produce the full length molecule.

B. Therapeutic Uses and Compositions Utilizing the DNKV Product

The DNKV product of the invention is generally useful in treating diseases and disorders which are characterized by a lower than normal level of DNKV expression, and or diseases which can be cured or ameliorated by raising the level of the DNKV product, even if the level is normal.

DNKV products or fragments may be administered by any of a number of routes and methods designed to provide a consistent and predictable concentration of compound at the target organ or tissue. The product-containing compositions may be administered alone or in combination with other agents, such as stabilizing compounds, and/or in combination with other pharmaceutical agents such as drugs or hormones.

DNKV product-containing compositions may be administered by a number of routes including, but not limited to oral, intravenous, intramuscular, transdermal, subcutaneous, topical, sublingual, or rectal means as well as by nasal application. DNKV product-containing compositions may also be administered via liposomes. Such administration routes and appropriate formulations are generally known to those of skill in the art.

The product can be given via intravenous or intraperitoneal injection. Similarly, the product may be injected to other localized regions of the body. The product may also be administered via nasal insufflation. Enteral administration is also possible. For such administration, the product should be formulated into an appropriate capsule or elixir for oral administration, or into a suppository for rectal administration.

The foregoing exemplary administration modes will likely require that the product be formulated into an appropriate carrier, including ointments, gels, suppositories. Appropriate formulations are well known to persons skilled in the art.

Dosage of the product will vary, depending upon the potency and therapeutic index of the particular polypeptide selected.

A therapeutic composition for use in the treatment method can include the product in a sterile injectable solution, the polypeptide in an oral delivery vehicle, the product in an aerosol suitable for nasal administration, or the product in a nebulized form, all prepared according to well known methods. Such compositions comprise a therapeutically effective amount of the compound, and a pharmaceutically acceptable carrier or excipient. Such a carrier includes but is not limited to saline, buffered saline, dextrose, water, glycerol, ethanol, and combinations thereof.

EXAMPLE III

Screening Methods for Activators and Deactivators (Inhibitors)

The present invention also includes an assay for identifying molecules, such as synthetic drugs, antibodies, peptides, or other molecules, which have a modulating effect on the activity of the DNKV product, e.g. activators or deactivators of the DNKV product of the present invention. Such an assay comprises the steps of providing an DNKV product encoded by the nucleic acid sequences of the present invention, contacting the DNKV protein with one or more candidate molecules to determine the candidate molecules modulating effect on the activity of the DNKV product, and selecting from the molecules a candidate's molecule capable of modulating DNKV product physiological activity.

The DNKV product, its catalytic or immunogenic fragments or oligopeptides thereof, can be used for screening therapeutic compounds in any of a variety of drug screening techniques. The fragment employed in such a test may be free in solution, affixed to a solid support, borne on a cell membrane or located intracellularly. The formation of binding complexes, between DNKV product and the agent being tested, may be measured. Alternatively, the activator or deactivator may work by serving as agonist or antagonist, respectively, of the DNKV receptor, binding entity or target site, and their effect may be determined in connection with any of the above.

Another technique for drug screening which may be used provides for high throughput screening of compounds having suitable binding affinity to the DNKV product is described in detail by Geysen in PCT Application WO 84/03564, published on Sep. 13, 1984. In summary, large numbers of different small peptide test compounds are synthesized on a solid substrate, such as plastic pins or some other surface. The peptide test compounds are reacted with the full DNKV product or with fragments of DNKV product and washed. Bound DNKV product is then detected by methods well known in the art. Substantially purified DNKV product can also be coated directly onto plates for use in the aforementioned drug screening techniques. Alternatively, non-neutralizing antibodies can be used to capture the peptide and immobilize it on a solid support.

Antibodies to the DNKV product, as described in Example IV below, may also be used in screening assays according to methods well known in the art. For example, a "sandwich" assay may be performed, in which an anti-DNKV antibody is affixed to a solid surface such as a microtiter plate and DNKV product is added. Such an assay can be used to capture compounds which bind to the variant DNKV. Alternatively, such an assay may be used to measure the ability of compounds to influence with the binding of variant product to the variant receptor, and then select those compounds which effect the binding.

EXAMPLE IV

Anti-DNKV Antibodies/Distinguishing Antibodies

A. Synthesis

In still another aspect of the invention, the purified DNKV product is used to produce anti-DNKV antibodies which have diagnostic and therapeutic uses related to the activity, distribution, and expression of the DNKV product. As indicated above, the antibodies may also be directed solely to amino acid sequences present in the variant but not present in the original kinase sequence, or to sequences present only in the original kinase sequence but not in the DNKV (distinguishing antibodies).

Antibodies to the DNKV product or to the distinguishing sequence present only in the DNKV or only in the original kinase sequence (the latter termed "distinguishing antibodies") may be generated by methods well known in the art. Such antibodies may include, but are not limited to, polyclonal, monoclonal, chimeric, humanized, single chain, Fab fragments and fragments produced by an Fab expression library. Antibodies, i.e., those which inhibit dimer formation, are especially preferred for therapeutic use.

A fragment of the DNKV product for antibody induction does not require biological activity but have to feature immunological activity; however, the protein fragment or oligopeptide must be antigenic. Peptides used to induce specific antibodies may have an amino acid sequence consisting of at least five amino acids, preferably at least 10 amino acids of any sequences coded by the nucleic acid sequence of SEQ ID NO: 1 to SEQ ID NO: 91 or in distinguishing sequences present only in the DNKV or only in the original kinase sequence as explained above. Preferably they should mimic a portion of the amino acid sequence of the natural protein and may contain the entire amino acid sequence of a small, naturally occurring molecule. Short stretches of DNKV protein amino acids may be fused with those of another protein such as keyhole limpet hemocyanin and antibody produced against the chimeric molecule. Procedures well known in the art can be used for the production of antibodies to DNKV product.

For the production of antibodies, various hosts including goats, rabbits, rats, mice, etc may be immunized by injection with DNKV product or any portion, fragment or oligopeptide which retains immunogenic properties. Depending on the host species, various adjuvants may be used to increase immunological response. Such adjuvants include but are not limited to Freund's, mineral gels such as aluminum hydroxide, and surface active substances such as lysolecithin, pluronic polyols, polyanions, peptides, oil emulsions, keyhole limpet hemocyanin, and dinitrophenol. BCG (bacilli Calmette-Guerin) and Corynebacterium parvum are potentially useful human adjuvants.

Monoclonal antibodies to DNKV protein may be prepared using any technique which provides for the production of antibody molecules by continuous cell lines in culture. These include but are not limited to the hybridoma technique originally described by Koehler and Milstein (Nature 256:495–497, (1975)), the human B-cell hybridoma technique (Kosbor et al., Immunol. Today 4:72, (1983); Cote et al., *Proc. Natl. Acad. Sci.* 80:2026–2030, (1983)) and the EBV-hybridoma technique (Cole, et al., *Mol. Cell Biol.* 62:109–120, (1984)).

Techniques developed for the production of "chimeric antibodies", the splicing of mouse antibody genes to human antibody genes to obtain a molecule with appropriate antigen specificity and biological activity can also be used (Morrison et al., *Proc. Natl. Acad. Sci.* 81:6851–6855, (1984); Neuberger et al., *Nature* 312:604–608, (1984); Takeda et al., *Nature* 314:452–454, (1985)). Alternatively, techniques described for the production of single chain antibodies (U.S. Pat. No. 4,946,778) can be adapted to produce single-chain antibodies specific for the DNKV protein.

Antibodies may also be produced by inducing in vivo production in the lymphocyte population or by screening recombinant immunoglobulin libraries or panels of highly specific binding reagents as disclosed in Orlandi et al. (*Proc. Natl. Acad. Sci.* 86:3833–3837, 1989)), and Winter G and Milstein C., (*Nature* 349:293–299, (1991)).

Antibody fragments which contain specific binding sites for DNKV protein may also be generated. For example, such fragments include, but are not limited to, the $F(ab')_2$ fragments which can be produced by pepsin digestion of the antibody molecule and the Fab fragments which can be generated by reducing the disulfide bridges of the $F(ab')_2$ fragments. Alternatively, Fab expression libraries may be constructed to allow rapid and easy identification of monoclonal Fab fragments with the desired specificity (Huse W. D. et al., *Science* 256:1275–1281, (1989)).

B. Diagnostic Applications of Antibodies

A variety of protocols for competitive binding or immunoradiometric assays using either polyclonal or monoclonal antibodies with established specificities are well known in the art. Such immunoassays typically involve the formation of complexes between the DNKV product and its specific antibody and the measurement of complex formation. A two-site, monoclonal-based immunoassay utilizing monoclonal antibodies reactive to two noninterfering epitopes on a specific DNKV product is preferred, but a competitive binding assay may also be employed. These assays are described in Maddox D. E., et al, (*J. Exp. Med.* 158:1211, (1983)).

Antibodies which specifically bind DNKV product or distinguishing antibodies which bind to sequences which distinguish the DNKV from the original kinase sequence (as explained above) are useful for the diagnosis of conditions or diseases characterized by expression of the novel DNKV of the invention (where normally it is not expressed) by over or under expression of DNKV as well as for detection of diseases in which the proportion between the amount of the DNKV of the invention and the original kinase sequence from which it varied is altered. Alternatively, such antibodies may be used in assays to monitor patients being treated with DNKV product, its activators, or its deactivators. Diagnostic assays for DNKV protein include methods utilizing the antibody and a label to detect DNKV product in human body fluids or extracts of cells or tissues. The products and antibodies of the present invention may be used with or without modification. Frequently, the proteins and antibodies will be labeled by joining them, either covalently or noncovalently, with a reporter molecule. A wide variety of reporter molecules are known in the art.

A variety of protocols for measuring the DNKV product, using either polyclonal or monoclonal antibodies specific for the respective protein are known in the art. Examples include enzyme-linked immunosorbent assay (ELISA), radioimmunoassay (RIA), and fluorescent activated cell sorting (FACS). As noted above, a two-site, monoclonal-based immunoassay utilizing monoclonal antibodies reactive to two non-interfering epitopes on DNKV product is preferred, but a competitive binding assay may be employed. These assays are described, among other places, in Maddox, et al. (supra). Such protocols provide a basis for diagnosing altered or abnormal levels of DNKV product expression. Normal or standard values for DNKV product expression are established by combining body fluids or cell extracts taken from normal subjects, preferably human, with antibody to DNKV product under conditions suitable for complex formation which are well known in the art. The amount of standard complex formation may be quantified by various methods, preferably by photometric methods. Then, standard values obtained from normal samples may be compared with values obtained from samples from subjects potentially affected by disease. Deviation between standard and subject values establishes the presence of disease state.

The antibody assays are useful to determine the level of DNKV product present in a body fluid sample, in order to determine whether it is being expressed at all, whether it is being overexpressed or underexpressed in the tissue, or as an indication of how DNKV levels of variable products are responding to drug treatment.

C. Therapeutic Uses of Antibodies

In addition to their diagnostic use the antibodies may have a therapeutical utility in blocking or decreasing the activity of the DNKV product in pathological conditions where beneficial effect can be achieved by such a decrease. Again, distinguishing antibodies may be used to neutralize differentially either the DNKV or the original kinase sequence as the case may be.

The antibody employed is preferably a humanized monoclonal antibody, or a human Mab produced by known globulin-gene library methods. The antibody is administered typically as a sterile solution by IV injection, although other parenteral routes may be suitable. Typically, the antibody is administered in an amount between about 1–15 mg/kg body weight of the subject. Treatment is continued, e.g., with dosing every 1–7 days, until a therapeutic improvement is seen.

Although the invention has been described with reference to specific methods and embodiments, it is appreciated that various modifications and changes may be made without departing from the invention.

SEQUENCE LISTING (273 sequences)

SEQ ID NO: 1 - DNA, 1573 bp, Homo sapiens
ccggctcgacggctcggtcaccgcctcgctgtcgtcgcggcgcccccggccgtcctctgtccgtaccgcccccggagccagggccgagtcctcgccatgccggcccggcggctgctgctgctgctgacgctgctgctgcccggcctcgggatttttggaagtaccagcacagtgacgcttcctgaaaccttgttgtttgtgtcaacgctggatggaagtttgcatgctgtcagcaagaggacaggctcaatcaaatggactttaaaagaagatccagtcctgcaggtcccaacacatgtggaagagcctgcctttctcccagatcctaatgatggcagcctgtatacgcttggaagcaagaataatgaaggcctgacgaaacttccttttaccatcccagaattggtgcaggcatccccatgccgaagttcagatggaatcctctacatgggtaaaaagcaggacatctggtatgttattgacctcctgaccggagagaagcagcagactttgtcatcggcctttgcagatagtctctgcccatcaacctctcttctgtatcttgggcgaacagaatacaccatcaccatgtacgacaccaaaacccgagagctccggtggaatgccacctactttgactatgcggcctcactgcctgaggacgaaggggactacaagatgtcccactttgtgtccaatggtgatgggctggtggtgactgtggacagtgaatctggggacgtcctgtggatccaaaactacgcctcccctgtggtggccttttatgtctggcagcgggagggtctgaggaaggtgatgcacatcaatgtcgctgtggagaccctgcgctatctgaccttcatgtctggggaggtggggcgcatcacaaagtggaagtacccgttccccaaggagacagaggccaagagcaagctgacgcccactctgtatgttgggaaatactctaccagcctctatgcctctccctcaatggtacacgagggggttgctgtcgtgccccgcggcagcacacttcctttgctggaagggccccagactgatggcgtcaccatcggggacaagggggagtgtgtgatcacgcccagcacggacgtcaagtttgatcccggactcaaaagcaagaacaagctcaactacttgaggaattactggcttctgataggacaccatgaaaccccactgtctgcgtctaccaagatgctggagagatttcccaacaatctacccaaacatcgggaaaatgtgattcctgctgattcagagaaaaagagctttgaggaaactttgttacagatgacttcagtgttttcctggatactgaacctaccatcaaaggaggaagtgtttgcctttttgaggatttttgaaaaaaatatgtagggtctgaagacacctgccaaaagtattgctccaaaaactatttttgaataatgataacctcactgcaaagatgcatggcctctcaaagcaattgctttgaaagaggcaacagttatctggctacatgatctttggtgagcttaaaacaaataaaaccccctgcagtacagtc

SEQ ID NO: 2 - DNA, 1669 bp, Homo sapiens
  - (1)..(1669): "n" can be any nucleotide 'a', 'c' , 'g' or 't'
acctagtttatacccagatatttcatatttataggctcaatctctagaaccatcctgccatgtaggtaattgttagatttcgaggatgaagctctgagacactgagagaaggtaaccaattaatatgagccaggattcaaagtctgtggttnctaaagttatttcccgttctacactgtcttttccttcagttatatgttatattctcaactctttatattttctttccatgtattttgtacaaacatataaaatgtgttagattgtattttacttctataatttcctaatcatctccagttaaagtgtatatatatttatgtattcattacagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgcagtattttttttaattaatacaagtaaaaagtttgaattttgctacatagttcaatttttatgtctcttttgttaacagaaaccacttttaaaggatagtaattattcttgtttataacagtgccttaaggtatgatgtatttctgatggaagccattttcacattcatgttcttcatggattatttgttacttgtctaagatgcaatttgattttatgaagtatataccctttacccaccagagacagtacagaatccctgccctaaaatcccaggcttaattgccctacaaagggttattaatttaaaactccattattaggattacattttaaagttttatttatgaattccctttaaaaatgatatttcaaaggtaaaacaatacaatataaagaaaaaaataaatatattaataccggcttcctgtccccatttttaacctcagccttccctactgtcaccaacaaccaagctaaataaagtcaacagcctgatgtgtaaaa

SEQ ID NO: 3 - DNA, 1101 bp, Homo sapiens
gctcggcctcgggcgcggccgagcgccgcgcgagcaggagcggcggcggcggcggcggcggcgggaggaggcagcgccgscccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctgaaaaatcataaa

SEQ ID NO: 4 - DNA, 2451 bp, Homo sapiens
  - (1)..(2451): "n" can be any nucleotide 'a', 'c' , 'g' or 't'
ctgccctggtgcacacagatggcacatggcagagcccaagccctctccatgagatctgcagcgtttgtccacacggcagggcaaattaccttgtagagtcagcatggaggtttgcaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagcgggcccctgttgcacttgctcactgggnactggggaggctctgatcgcagaccgggggtgctgcyacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcgggatctgaagagctatggtgaaacaccactgaagcattgccaaggatggggctggtaagtagcaaaaagccggacaaggaaaagccgatcaaagagaaggacaagggccaatggagccccctgaaggtcagcgcccaagacaaggacgccccgccactgccgcccctggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagyaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctagttactacaaaaacaacatgaaggtggccattaagacgctgaaggagggaaccatgtctccagaagccttcctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgyacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcagccccagcctaggctgcgctccagcactgcggggcttttctgcaataaagtcacgagcgttcgagctgtca

SEQ ID NO: 5 - DNA, 692 bp, Homo sapiens
ggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaaagcattttttttttatgatttgtctctgtcacccttgtccttgagtgctcttgctattaacgttatttgtaatttagtttgtagctcattaaaaaaatgtgcctagttttatagttcaaaa

SEQ ID NO: 6 - DNA, 842 bp, Homo sapiens
cccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagtatacagctgaaggacacttatgagaccaacactttcttcttcttggtgtttgacctgatgaagagaggggagctctttgacttacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgaggtctggtaacatgccttggcccacgtccaggcctcgggtgctcaatcaaccatctgcagaatagagatggtctgggtttctcccctaacttaattgttccctggaataaaaattccaccatttcaa

SEQ ID NO: 7 - DNA, 676 bp, Homo sapiens
gtgagccaccgcccccagcctggcctggcatttctttgagttcaggaagtgtgacaaggatttggacacccagaaataagcgwgtcgmgmwgmgcrcaagsagmggrkccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggcctggtccctagatggcacttggtgacacacactc

SEQ ID NO: 8 - DNA, 1019 bp, Homo sapiens
cgtctgttcctcggctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgctgctgcacttcctgttcatgtacgaccctaagaaaagggcgacggccggggactgcctggagagctcctatttcaaggagaagcccctacgtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacagacatggttaaaa

SEQ ID NO: 9 - DNA, 848 bp, Homo sapiens
gtgagccaccgcccccagcctggcctggcatttctttgagttcaggaagtgtgacaaggatttggacacccagaaataagcgwgtcgmgmwgmgcrcaagsagmggrkccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacagacatggttaaaa

SEQ ID NO: 10 - DNA, 2418 bp, Homo sapiens
cctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgtgaaacgaagttctaatttcatgtacctgatgggtggatttcgatgtgtcaagtgtgatgataaggaatatggtattgtttattatgaaaaggacggtgatgaatcatctccaattttaacaagttttgaattagtgaaagttcctgacccccagatgtccctggagaatttagttgagagcaaacaccacaaccttccccggagtttaagaagtggaccttctgaccacgatctgaaaccctatccttccccgagagatcagttaaaaaatattgtgagttatcctccatccaagccacccacatatgaagaacaagatcttgtttgggagtttagatattatcttacgaatcaagataaagccttgaccaaaatcctgacatctgttatttgggatctacctcagggggccaaacaggccttggcacttctggggaaatggaacccgatggatgtagaggactccttggagctgatatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggaggctgaggcaggagaatcgcttgaacccgggaggcggaggttgcagtgagccgagattgcaccattgcactgcagactaggcaacaagatcaaaacgccatcttag

SEQ ID NO: 11 - DNA, 1894 bp, Homo sapiens
cctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgtgaaacgaagttctaatttcatgtacctgatgggtggatttcgatgtgtcaagtgtgatgataaggaatatggtattgtttattatgaaaaggacggtgatgaatcatctccaattttaacaagttttgaattagtgaaagttcctgacccccagatgtccctggagaatttagttgagagcaaacaccacaaccttccccggagtttaagaagtggaccttctgaccacgatctgaaaccctatccttccccgagagatcagttaaaaaatattgtgagttatcctccatccaagccacccacatatgaagaacaagatcttgtttgggagtttagatattatcttacgaatcaagataaagccttgaccaaaatcctgacatctgttatttgggatctacctcagggggccaaacaggccttggcacttctggggaaatggaacccgatggatgtagaggactccttggagctgatatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtaaaaataattttctgtttattttcttattacccttaagaattattttttctcatgctataaacacaaagatgatttaaaataagatatgagcaatcatcaaaagtctagatatagtatttatatctaactgtattccctgacagctgggttcatggaaatgcttgttggcatcaacatttctctccctttcactaaggatataactttccaggagctaggatataactggggagggtaatgggtactttcagtttaatatctgtttggcatgtaaagtagttgagtatgatatttcacagttcttcaggagtatatattttcacattatttactaaaacattggaatcatttaaaaa

SEQ ID NO: 12 - DNA, 750 bp, Homo sapiens
  - (1)..(750): "n" can be any nucleotide 'a', 'c' , 'g' or 't'
cagtgngctccgggccgccggccgcagccagcacccgccgcgccgcagctccgggaccggccccggccgccgccgccgcgatgggcaacgccgccgccgccaagaagggcagcgagcaggagagcgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcaggtaagcgggccaccccccatcacatcaggctgtcagggtgtccacaggtggcagtgcacgaccaagccccctgggaatgcagaggagtccagcatacttcaacatgcaggtggtctcccagaccctgtgggtttctgtttcccctctgctgaggaatatgtgatatttcaaccaccacaaancaaaacagagcaaacagggcaacttaggtgtccaaactgaagttgctgccaggcgcggtggttctcacc

SEQ ID NO: 13 - DNA, 794 bp, Homo sapiens
ctccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggattgatctggagccagaaggaagagtgtatgtgatcatcgatctctcagggtcgtcgggtgaagtgaaaatacctaactctgcattctgtgaaagggagagagttgaaatgaggcacagctgaagtttcaccactccattattctgccatcaagcatcccttcagctcccatctctcaaatgctgcagccccatcaatggaaaaaaatacattcatgggaattgcacaaagtttacaacacatgcaaattccaaggagctcagagagaggtgtgggggtgagatggtgtgactacacccccttcttctaggatgcgccgaaggattctttttcttgctcatatgctgttagaaagcctgggcgtttacgtctgctggagctggagctaatgtgatttctaactgtctaataaaattccactgcttgcaaaa

SEQ ID NO: 14 - DNA, 2083 bp, Homo sapiens
catcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctacaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggtgaggatgatgtggtgggcagggcgtcaagggagaaacctcagcaagcatcaggtaggtatgacacgcctgctcccagttcattgcatctatttttagtctctgctaacctcctgagaagtccacattctctttctagatttggtctgccgctgctcctggcctaatttgagcaactctcctttgctactgaatataagatgtgtggagggacccacataccaaa

SEQ ID NO: 15 - DNA, 1215 bp, Homo sapiens
gcggaatcctaaaccagcccaatttacatccattcatgaatctgtgacgtcagcaagcctttgggctcctttgcggtgggctggaggattgtgtgggtggaatccccctcccctttatttttccaattctgcaaggcttttaaaattcaccttacatcttttcaaagcaagaaaatggaacagcatgtgtaggaattcttcgttgttgttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaagtgagttctggggctaatgtttcagctattttggtttgttgttttgaaatacagaatttttatcaacctcaa

SEQ ID NO: 16 - DNA, 1327 bp, Homo sapiens
gggattgtgctatccaccataaaaagcatagcatactgtgtgtatgtaagtcctcccagggcttcattcttgtataatatagaatatgtaactatatacatatgatttttttaactcagtcactgtaatggttcgttttaatttttcattttggatttttttttaatttcctttgctacttagattagaaagaacattgatctttcaaacatagatctgaatatgaaagagaaaagaaacacttccatatttggttagaagtctatgtgtggacagagatggatacataatttcacatgcttggcattcctttttcacactttaaaatcaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagagccttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgaakwgaaaaaa

SEQ ID NO: 17 - DNA, 364 bp, Homo sapiens
aattcggcacgaggtgggactttcctctcgctgcctcccggctctgcccgcccttcgaaagtccagggtccctgcccgctaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggtccctgtccgacctgtgggcgccaatggccctcccctgacctcagggttccttgggggctgggctgaggcctcagtacagagggggctctggaaatgtttgttgactgaataaaggaattcagtggaaac

SEQ ID NO: 18 - DNA, 923 bp, Homo sapiens
cgctgctgggctgcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccwttttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcaggtaccaagttcttcagggcatcatgtctgtggttggctttcatcagtttcccagcaggatagagtgcttgtagagaaggctggaggccctgcatttgtttctaccagcattgagtcatttggtttcctagttccccttcttttggagtctgacgtgtaataagataagataatgggttcacagaaaatctctcattccgtgggattcccaaggtctagtacacaattatccactacagaagtcctgcctctctaagctttgcaactgtacgtacatctattaaaattcagctggtcccccctga

SEQ ID NO: 19 - DNA, 1739 bp, Homo sapiens
  - (1)..(1739): "n" can be any nucleotide 'a', 'c' , 'g' or 't'
ccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctgaggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtgtgaggagctgtccctggctaggaggagactgcccaggtggtctcagacaagctacgggggcaaacagctgggcccctgggacccttaggctcagcaggtggtggctttggcccaaatgcaccacatgggataagccttggagtgtctgaagcctggctccactattgtgtgacaagcctcttctcctctctgaatctttagtttttccatgtttaaactagggaaagaagcacacccttcatccctgccatattaagatatttagggggctttggaagggaaatgcatttgaatcaatgcangaagaagcatttaaccaatgancttcagccaatcctctgncttcttaggactctgacttcaggtccgnagtgactaggggcactggggcttgctccagattgtggtgggagaatgctctactaagagattgatggggtgctggggtggagggggggaagcctgnagcccaagagaccctgttcctggnagaatgaatggggaatattcataaataatgtacacaaagtaactctttccttctgctctccctgttagctcccaagtgccccccatcaaacctgggcgcccg

SEQ ID NO: 20 - DNA, 1832 bp, Homo sapiens
  - (1)..(1832): "n" can be any nucleotide 'a', 'c' , 'g' or 't'
ccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagaaaaaacacaacagcagcagctcagcccttctgaacagccccacagtaacaacaagctcatgtgcaggggccagtgagaaaaagaaatttttgagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctgaggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtgtgaggagctgtccctggctaggaggagactgcccaggtggtctcagacaagctacgggggcaaacagctgggcccctgggacccttaggctcagcaggtggtggctttggcccaaatgcaccacatgggataagccttggagtgtctgaagcctggctccactattgtgtgacaagcctcttctcctctctgaatctttagtttttccatgtttaaactagggaaagaagcacacccttcatccctgccatattaagatatttagggggctttggaagggaaatgcatttgaatcaatgcangaagaagcatttaaccaatgancttcagccaatcctctgncttcttaggactctgacttcaggtccgnagtgactaggggcactggggcttgctccagattgtggtgggagaatgctctactaagagattgatggggtgctggggtggagggggggaagcctgnagcccaagagaccctgttcctggnagaatgaatggggaatattcataaataatgtacacaaagtaactctttccttctgctctccctgttagctcccaagtgccccccatcaaacctgggcgcccg

SEQ ID NO: 21 - DNA, 1269 bp, Homo sapiens
agcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaattttttttttttttwaatttttttttttycccccaaa

SEQ ID NO: 22 - DNA, 623 bp, Homo sapiens
  - (1)..(623): "n" can be any nucleotide 'a', 'c' , 'g' or 't'
agccctcccagtttccgcgcgcgtctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtgccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggtgagtggggttggtaggcattganaggtggattgggaccttt

SEQ ID NO: 23 - DNA, 502 bp, Homo sapiens
agccctcccagtttccgcgcgcgtctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtgccctcaagagtgtgagagtccccacccacctctccttttgaggcttctccttctccttcccatttctctacactaaggggtatgttccctcttgtccctttccctacctttatatttggggtccttttttatacaggaaaaacaaaacaaagaaataaagtcgacgcggccgcgaattc

SEQ ID NO: 24 - DNA, 1148 bp, Homo sapiens
  - (1)..(1148): "n" can be any nucleotide 'a', 'c' , 'g' or 't'
catcatatgaggtggacaggaagcccagccaagccatgggggccgacccctcccntggattcacttgcntttgagccacacaccctccagccactacccatagcagttatgggggtgtgtcctgggaagactcctttctgctccccaaaaccccaaggcctggctcggggccactggagccgcaggcgggacatatgtgtgaccggccctctgcccctggcagccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatcaaaaaaaaaaaaatgtgactcaagacttccagagcctcaaatgagaaaatgtctttattaaatgtagaaagtgatccatacttc

SEQ ID NO: 25 - DNA, 1679 bp, Homo sapiens
  - (1)..(1679): "n" can be any nucleotide 'a', 'c' , 'g' or 't'
ccaagattctctgacctcagcgttccaggagcnccattcagcctttgactaggcaggtcggtcaacgtccagccgggtccaggcatcctattgcatcttatgttccactcctgaagagtgggcattttcctgtgtcctcccacacctgcactctcccaaggctcttgtggtcactctgagatggcagattggggtccctgttgtccttggacagatgagaatgccgagagctcgtatgcctnggccaagggcacacagcaaggccgggtgcccatgcggctgtcccagggacccactgaccctgctgtccccctcaggccacattaggatctcagacctgggcttggctgtgaagatccccgagggagacctgatccgcggccgggtgggcactgttggctacatggctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatcaaaaaaaaaaaaatgtgactcaagacttccagagcctcaaatgagaaaatgtctttattaaatgtagaaagtgatccatacttc

SEQ ID NO: 26 - DNA, 897 bp, Homo sapiens
  - (1)..(897): "n" can be any nucleotide 'a', 'c' , 'g' or 't'
ccaagattctctgacctcagcgttccaggagcnccattcagcctttgactaggcaggtcggtcaacgtccagccgggtccaggcatcctattgcatcttatgttccactcctgaagagtgggcattttcctgtgtcctcccacacctgcactctcccaaggctcttgtggtcactctgagatggcagattggggtccctgttgtccttggacagatgagaatgccgagagctcgtatgcctnggccaagggcacacagcaaggccgggtgcccatgcggctgtcccagggacccactgaccctgctgtccccctcaggccacattaggatctcagacctgggcttggctgtgaagatccccgagggagacctgatccgcggccgggtgggcactgttggctacatggctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatggtgagctcctggtggccagatgccaccctcaagctggtggctcccctccctgggcctggccccagtctgtccccagaacagcaaacaggctgaagggacaggggtctgagcatgggggtgggggttgcagcccaccaagctagagttgagggcactccttgctgaggactggggtggtcagcggagacttccaggagaaagcctgggtggggcagggacacccagtaaccaagggaagaggggtgaggggaacagtgtggaacaccctcacatccagcctg

SEQ ID NO: 27 - DNA, 1224 bp, Homo sapiens
tgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctcctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaaggagcacaagctgtttgaaccaccaggtttatttgtgtgtctaaataaacaccaaatagtaccaaaaa

SEQ ID NO: 28 - DNA, 1424 bp, Homo sapiens
ttttttgcgtatgtattatgatgtatgtaaaaatacataatctttccatatgcattatgatatatataaaactaaggtaacaagttgtgaggagtgggtaggttggcttggatagtgggtaggtagggttggaggaggcaaatgatatggtggaacaaggaccttgaaatcaatccaaaacccaggttttcctaggaaggccacccggaacccatggtaagccaactgttgcgcagggatagtgcctcagcaggagacttggcagaaggcagacagaaggaagatgggaacactggtagtcctggcagcgttgaggaggctccagcagagatccagtgctaagggccctagaggggctggtggcatcccctcaatcttggtcctctctccccagagttgtgtgggaccccagggtatctagcgccagagatccttaaatgctccatggatgaaacccacccaggctatggcaaggaggtcgacctgtgagttcctggtctccccctccctcccgtgcttgctgtcctttgctgggtctgcccgtcacctagtcccgcctgactccaatctcttttccaagctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccagggaaaatgaggta

SEQ ID NO: 29 - DNA, 2027 bp, Homo sapiens
gcggccgcggagtatcctggagctgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaagacaagaaggatgaggagaaaaacaagatccgggaagagtggaacaatttttcattcttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgaggttcgtctccctgtgccagagccaggctgtatcccatcagtaatgtgctgagacccagatcgaccaaaacacgctgactgacttaaacaaagtggaccctcccccca

SEQ ID NO: 30 - DNA, 1609 bp, Homo sapiens
gccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccgcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtatgctgagactcaattactctcttattagcttccccgtttggaagatcccaaacaccaaagatggaaggtgaaaataaagactgcgtgaccgggaagaaagtttgaattactaatagtggggaataataatttcagttttggttttaacattctggaattcctaaaa

SEQ ID NO: 31 - DNA, 1995 bp, Homo sapiens
  - (1)..(1995): "n" can be any nucleotide 'a', 'c' , 'g' or 't'
gccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccgcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttgacagggtctcactctgtcacccaggctgacacgatcatggctcactacaatctctgccttcctgcctcaagggttcttccttgagcacctcagcctcccaagtagctgggaccacaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggttgggcaacacctctcctgtctccagctcacagtgccttaaggggttgtttaggggagagaaatggaagtttcctacttgctacttttctagtttctgcctgggtcaagtattcccattaggaaccaccagttatgtgctcgttaatgaaaacattttttaaaacagactaaccttgcgtttaccccaccccaaatccttatgaaatgccaaatactttttacatgttatgtgtgtcagaaattcatncttctntcc

SEQ ID NO: 32 - DNA, 2590 bp, Homo sapiens
gcacgagactggaactgcctgcggggcattgggagcgcccagacctggagctgctggaaagagtacccagcaagggagagcctgggacttggagctgctagagaagggtgctgggagcctcccgcttacgtatggaaagtgtctttgtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattctttttcttgtatttcctgaggggtgccagggcctgggatccagcgaacatctctgcttcatcagccccaggctgcccagcctctgccagtcttgtgggggaaagggggtgacagtgtctctctgtggaccaggctggagtgcagtggcatgatcctggctcactgcagcctcgaactcctgggctcaagtgattctcccacctcagcctcccaagcagctgggactacaggcgtgcgccaccatgcctggctaattttacaaattttttgtagaaatggggtgttgccatgttggccaggctggtctcgaactcctgagctcaagtgatcctctcactcagcctcccaaaatgctgggattacaggtgtgagccactgcacccagcctgattctgaggccagccacaggctcagctcttcagtgagccagcacggagaccatctgtgtggcatccagcccacctcacctccctgtggccccagggsatggctcctggcctctgagtctggcgggtagtagggcaggaagaggctctcagaggcgcagctcctcatggctcggtgcgtgtggaggagcagccgtggggagcggtttgtgagtactggacgaagccatcaggacttggcgagtgcctgtcgcacctcaactgggagcttcttgtatggtgcctcttgtctcacagcacggagcaggtctcgcactgatgtccccttatagggaccggactttctcag

SEQ ID NO: 33 - DNA, 1096 bp, Homo sapiens
  - (1)..(1096): "n" can be any nucleotide 'a', 'c' , 'g' or 't'
ggctcctggatccggctacctggcagaggctcctggccactgttcgcaggtcttcccttgctctgaaagcagcagaggctctgctcacgggcaggctaggctttcatcacggtaggatagggaaggccatggctctgttgcctccttttcttgcctctcacagattggaagtatctagggacagtgggtggctaggacagtgctggctgcagggggtctgggagcgtkggcctcacagtggccttctctatcctctgcaacaccctccagccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggggcttcctcgagccaggctcagccccgtgacagccccatgacagcgaagggacctttctgtccccgcccctgtccctgtgctgggcccacgtactcacccacgtactggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcaaaawrgtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggg

SEQ ID NO: 34 - DNA, 940 bp, Homo sapiens
ggctcctggatccggctacctggcagaggctcctggccactgttcgcaggtcttcccttgctctgaaagcagcagaggctctgctcacgggcaggctaggctttcatcacggtaggatagggaaggccatggctctgttgcctccttttcttgcctctcacagattggaagtatctagggacagtgggtggctaggacagtgctggctgcagggggtctgggagcgtkggcctcacagtggccttctctatcctctgcaacaccctccagccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggggcttcctcgagccaggctcagccccgtgacagccccatgacagcgaagggacctttctgtccccgcccctgtccctgtgctgggcccacgtactcacccacgtactggtaaggatcctctgaggtctggcttttccaaaatttgccacttgaccagtgagcgcaggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcaaaawrgtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggg

SEQ ID NO: 35 - DNA, 951 bp, Homo sapiens
  - (1)..(951): "n" can be any nucleotide 'a', 'c' , 'g' or 't'
ggctcctggatccggctacctggcagaggctcctggccactgttcgcaggtcttcccttgctctgaaagcagcagaggctctgctcacgggcaggctaggctttcatcacggtaggatagggaaggccatggctctgttgcctccttttcttgcctctcacagattggaagtatctagggacagtgggtggctaggacagtgctggctgcagggggtctgggagcgtkggcctcacagtggccttctctatcctctgcaacaccctccagccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggcggcccccttcctgccagccccctgcccttccctgtggacggccccaggatgaactagggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaamaaaaamaaaaawaaamsrcmaaaakwacmacwmaaaaacccagcaca

SEQ ID NO: 36 - DNA, 2063 bp, Homo sapiens
  - (1)..(2063): "n" can be any nucleotide 'a', 'c' , 'g' or 't'
gcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaagtatgtgcttgctttctacctgctcttaaattgaccagcagtgattctgggtcatcagaagttcataaaacactaaattaaggtttaaaataaaaaatgtacttattctttcaacttaaatatatgaattctattagagttttgaaaaaaatcataattgcttgcattcctattcacaatgactaataaaaccaaatttaattttcwctcgtaatttgtaatgtattaatttcctggggtattgtatatgttaaagatactttctgttattaagagattgaaataacacaaacactgaaattgggcagagtagaagtcagcatttagtgagaccaaataaaattagtaatgggcaagctgctgtttcctttgcttttagctccattttctcccataaacaaatatattcttcactttgcaagagatggagtagaagaagttttgaaatttgtatcctaaattagcttcaagtaagtgcctaaagagacctctttcccttaaaacctgttaatcagttaaaggcggggaacactggtgcctttttttttttttttttttaacttcttaaccaagggacagtgaagactttaagttagatctgattttagaattgcagttgaggtagtgcctagtgtgtgaatttgaggtcattttctaaactggccgggcacagtggctcatgcctgtaatcccagcactttgggaggcccaggtgggagaatcacttgagtccaggagtttgataccagcctgagcaacacagggaaccccatctctaccaaaa

SEQ ID NO: 37 - DNA, 1393 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgagttgcatccaaagaacaccatacctacagtgaagcatgggggaaacatcatgctttggggctgtttttc

SEQ ID NO: 38 - DNA, 1244 bp, Homo sapiens
ggccgggcttgcgcagcgctaggctcctcgccgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtaggtatttttgttggagattttccatttggttttgggtttggcatatagtcagaagggaagttttcaatttgaggtacaattaagaaaccaagtatattaattcagaaaatgaatccattttggagatagttgaaattttctgtttggggagttttgtttcccaaataaaaattaagttggaaagcaaa

SEQ ID NO: 39 - DNA, 3171 bp, Homo sapiens
gaattcccctgtgttagacggtacaggtggaagaagactgctgtgtgcaggaggaatttgcagtgagacttcaaggaagagaataagctcgccacataaagaggaaacaaagagcaacccagagttcagacccaggaagcggccgggagggcaggagcgaatcgggccgccgccgccatggagctgagagtcgggaacaggtaccggctgggccggaagatcggcagcggctccttcggagacatctatctcgtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggacgcaagggaccgagaggagcggctgagacactcgcggaacccggctacccgcggcctcccttccacagcctccggccgcctgcgggggacgcaggaaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcagctgccgcggggcaggggtgcagtgggtgttaccagggcaaagcactgcgcgcttcttccccagggaggtgggcaggcagctgagagcttggaagcagaggctttgagaccctagcaggacaattgggagtcccaggattcaaggtggaagatgcgtttctggtcccttgggagaggactgtgaaccgagagtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggmsrraaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtgggggccgagtcccaccagaaggcaggtggcctccgtgagctggtgctgccccaggctccatgctgctgtgccctgaggttcccaggatgccttctcgcctctcactccgcagcacttgggcggtagcagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtckmscttswrgaargkgscgcaagtttgcttttgtaaatatctgtggtcccgat

SEQ ID NO: 40 - DNA, 3743 bp, Homo sapiens
cggggatgtgtggagtggtggtcagctctaacgtgtcccttgcagactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcagggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtggcaggggtggtttgacctcttcagcccgtccggtggcctggaggcggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttca

SEQ ID NO: 41 - DNA, 1830 bp, Homo sapiens
  - (1)..(1830): "n" can be any nucleotide 'a', 'c' , 'g' or 't'
ctctttgtctccagcgcccagcactggnctggcaaaacctgagacgcccggtacatgttggccaaatgaatgaaccagattcagaccggcagggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaawwtttggctcactttgctgggtggaagagtgggtggccagggagggagtggggagtcctgggagggaagcagcatcctcagagcagctggtcctccccagctcctcctggtgggcaccgcaccccaacaggtttggggacaggctgtgtggtgggccgaggcgggagtatacaggcctgttcccaggggcagcctcccatggaaggtgttccacccccatct

SEQ ID NO: 42 - DNA, 3517 bp, Homo sapiens
gagagtattctctcagagcctgctttccactgggacctagttgttcctggactattccgtgaccccatgagcacttactatgtagttctcgtggattcagcagcaggtcgccttgtgtttccccttctcttcgttggtgtgtgcatatgtcagtgcttcccccagcaccccagcgtgtactttattttttccttttgatttgaggatatatgatccaggggaaatttcagtttggtataactactttaattagccataattattcattctaagtttttgctcagaaacaaatggcactggaaagaaattctttgttaaagggagaaagctaagcagttgcttttttggaggaggctttatatcggtagcctcatctcatgttttgattttgagaaggcgaaaagcctaaacaggatctccttgactccagagattaaggcctttcacgtctggattttttctccataggtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggctcatggtcatcactcaagctcccgtaaggatattaccgtctcaggaaaggatcaggactccatgtcacagtcctgccatcttactttcctcttgtcggagttctggagtgggaaataactggcattatgggccgctttaacccaggcattcaaaagaaac

SEQ ID NO: 43 - DNA, 3507 bp, Homo sapiens
cttaaactcactggttgcctaccttctgctttttggtacctggggtgatagttgtgactgcttctcacccttctcttttaatccctctgatgttacctgaccatgtaattgtgcacgctttgtggaattttaagcctgtcagagttttcatttcctgcttgaactgatttctgtacttctccctctccccttctttctcccgcgcttccttgtactgtgcattcctcatcaacgatggcttctcggactccacgaaactgcgctgtactgaagggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggctcatggtcatcactcaagctcccgtaaggatattaccgtctcaggaaaggatcaggactccatgtcacagtcctgccatcttactttcctcttgtcggagttctggagtgggaaataactggcattatgggccgctttaacccaggcattcaaaagaaac

SEQ ID NO: 44 - DNA, 3138 bp, Homo sapiens
ctctaatcgtccgccagagtacagttgaccaaaagcgtgccagccatcatgagagcaatggctttgcggttcgcattcacctcttgccagatctcttacagcaaagccattcctcctccacttcctccacctcctcctccccatcctccagccagccgacacccaccatgtccccacagacaccccagggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggctcatggtcatcactcaagctcccgtaaggatattaccgtctcaggaaaggatcaggactccatgtcacagtcctgccatcttactttcctcttgtcggagttctggagtgggaaataactggcattatgggccgctttaacccaggcattcaaaagaaac

SEQ ID NO: 45 - DNA, 2100 bp, Homo sapiens
  - (1)..(2100): "n" can be any nucleotide 'a', 'c' , 'g' or 't'
ccatggatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcagtcctgacttctgaacagctccatgatgcagaanggtttagtctggctggttttaatgtttcctcacaaggagtgcacttttctccagcacggagcctgccggtagcaaatgc

SEQ ID NO: 46 - DNA, 1479 bp, Homo sapiens
  - (1)..(1479): "n" can be any nucleotide 'a', 'c' , 'g' or 't'
gtgagtgagtggccgtattgttcctnnttcatttcgcatttcttgatagcgcctacatttgaacacattttcatatcacctcacatcacttagatatccttnccatgaagtacacattttggggttgggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttac

SEQ ID NO: 47 - DNA, 1223 bp, Homo sapiens
cccagggtccccgaggacgaagttgaccctgaccgggccgtctcccagttctgaggcccgggtcccactggaactcgcgtctgagccaccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtcgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaaga

SEQ ID NO: 48 - DNA, 1154 bp, Homo sapiens
cccagggtccccgaggacgaagttgaccctgaccgggccgtctcccagttctgaggcccgggtcccactggaactcgcgtctgagccaccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgcagaccagctggcgggtgtggagaccaggctcctgaccccgccatgcatgcagcgccacctggaagccgcgcggccgctttggttttttgtttggttggttccattttctttttttctttttttttttaaga

SEQ ID NO: 49 - DNA, 930 bp, Homo sapiens
accggtccccagcccacccctgagttcccagacaacagattatggaccgagagactactcccttgggtttactctggctcatccaagtcatacccagcaaactcctcccatccctgcaggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctaaaaa

SEQ ID NO: 50 - DNA, 2616 bp, Homo sapiens
taagagacagggtcttgccctgttgccaatgctggagtgcagtggcacaatcatagctcactgcagcctcgacctcccaggcttatgcagtcctcccatctcagcctcccaagtaaccgggactgcaggcgcatgccaccatggtcagctaatttaaaaaaaaaatgtttttggctgggcaaagtggatcacatctgtaatcccagcacctagggatgccaaggcaagaagattgcttgtgagcccagaagttcgagaccagcctgggcaacatggtgaaactctacctctaccaaaaaaatgtaaaaattagccatatttgacctcaagtctagacagaacttctttgtatattttagagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaag

SEQ ID NO: 51 - DNA, 1323 bp, Homo sapiens
gcgccgagccggtttccccgccggtgtccgagaggcgcccccggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtacagagcatgccagggtctcagttggacagtctgggtgggacccctccatcctccttccttcccagtctatggaaacacagtggaaggggtatctggctttcagactccctggccagtgccctctcctcccttggcctcctggagctaattaggaacaggg

SEQ ID NO: 52 - DNA, 1262 bp, Homo sapiens
gcgccgagccggtttccccgccggtgtccgagaggcgcccccggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttcgcaaggacctgggtcgctctgagtccctccgcgtagtctgccggccacaccgcatcttccggccgtcggacctcatccacggggaggtgctgggcaagggctgcttcggccaggctatcaaggtacagagcatgccagggtctcagttggacagtctgggtgggacccctccatcctccttccttcccagtctatggaaacacagtggaaggggtatctggctttcagactccctggccagtgccctctcctcccttggcctcctggagctaattaggaacaggg

SEQ ID NO: 53 - DNA, 2518 bp, Homo sapiens
tgagtaaatcgatacatcatacgcgcgctcctctggccgcccctccctccgacgatcggggaccctggcgggcggcaggaggacatggccagcgacgccgtgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccgaccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgccgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggatccttgcatcctcaaa

SEQ ID NO: 54 - DNA, 1464 bp, Homo sapiens
  - (1)..(1464): "n" can be any nucleotide 'a', 'c' , 'g' or 't'
tgagtaaatcgatacatcatacgcgcgctcctctggccgcccctccctccgacgatcggggaccctggcgggcggcaggaggacatggccagcgacgccgtgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccgaccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggatccttgcatcctcaaa

SEQ ID NO: 55 - DNA, 1080 bp, Homo sapiens
  - (1)..(1080): "n" can be any nucleotide 'a', 'c' , 'g' or 't'
ttggggactcattcctttattccattagcaagtattttctgcacatctggcacatgcagggattgtcctgggccctgcacagatggtaaacaatcagtcctacctccgcggggcactcctggtggtgaggtagctccaggtccaaaaggtcacaagaggtcatgttctccagctgtgggagccccaggagagaggcaaggcgnnctttggggtcaagcaaagcttcctggtggagggcaggtttaagcatgagatgtttgagaaggtgttcgctgaagagagaaatggtgggcagaggcttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtgcttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttatggtatcagataccaatatttaaaagtttgtataataataaagagtatgattgtggttcaaggataaaaa

SEQ ID NO: 56 - DNA, 1665 bp, Homo sapiens
tcgggctctgcgtctgcacagatacttcgagtctccaaggagacttctgcctgttcatttctgctgctgtcagtggcggggtgggggggtggattttgaatgcctcttgggtggtgtctgggatcgttgcaggaaggttctaagggctcaggagtgtgagtggcccaggcacctgccgtcagcctgtcttctgtcgtccgcctgtcgtgggcagccggagaggcgcgcggccgtggtgggagcccaggaccccactgagcccccacgcctgtctcgcagcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctctacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagataaa

SEQ ID NO: 57 - DNA, 2081 bp, Homo sapiens
cctaaatcaaatagtagtagcttttaaaaaaattactaaacttaatcaacactatttggaaagggggctagagtcagatattatgatcagttgatggctagctcaaggaatttttagaaatccccttccctacctccccagaatgtaccctacagccaaagtctcagcagcctacagggaaggaggctgaggagcaccctacatcagctcccctcacccattccctgctgcctccaacccctttatgggtggtttcccatttcatctttgatttaggggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagattctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaatagctatggactgttggatacaggatacagtggtgagaggagccccattttaggtctttcttttaggtttttggttttcattactccaagtagcccttgacccaagaacaaaggcttgttgtatgagttccactgccagatttatgggatgcctggatcattcagaaggatgcttcaactattatttgtcaggtccaaaggtcgtacttgataaccccattttctatgtatggggtagtctaatatattattttatctactttatttttcccttttcagaaagtccttagtgcaaaccaccattggaatctagtcagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggta

SEQ ID NO: 58 - DNA, 1097 bp, Homo sapiens
gcagccgcatctacggcagccgcccccggctcggggctgtgagcggctcggggccgggggtgggcggcggtgcggcgggcggccgacgctcctcttcggcggcggcggcggcggccatgcgtggggcggcgcggctggggcggccgggccggagttgcctcccggggcccgcgctgagggccccgccgcggccgccgctgctgcttctgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacaggtattgtacatattttgggaaagaaaaaaaatgaaagcagttatttgtatatatgtgggagcccatacacatctgatgacagtggtgcagggaaaggagggaggatgattaagccccagccaaaggaaaaataagatgacctaatcactgtctctggtttctctgaacttatttttattttttaaaaattaaggtc

SEQ ID NO: 59 - DNA, 3382 bp, Homo sapiens
  - (1)..(3382): "n" can be any nucleotide 'a', 'c' , 'g' or 't'
gcagccgcatctacggcagccgcccccggctcggggctgtgagcggctcggggccgggggtgggcggcggtgcggcgggcggccgacgctcctcttcggcggcggcggcggcggccatgcgtggggcggcgcggctggggcggccgggccggagttgcctcccggggcccgcgctgagggccccgccgcggccgccgctgctgcttctgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagctcctagttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgttgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagggccaactgctttttatttttttacttcatcaaggtgatgtaagtgactttgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattatgacagtattgaaattatttttcataatgaatgattggttattgtgtctggtaagtctttgaacattcaacagccagacatttgtgttttatttcatgatgttccagtcaagttccaaagccctaacacagttaagctggctcagactccaggttctagtaaaaagttggaattaatgttataaggaagtattaaaacactgaaacatttctccagaaccagcaagtaagggatatgtatgtatttatgctcagttttagttggcctaaagcagagttgaatgggctttctaaatagctaggcctgcaggtacctgccactactcccatcttcagaggtatataagggagaatgtgtagcagttngaggcttttgctgtttttaaaaaagccttatgaatcagcagcacatcgggaaaaataggctcacatagtacctgggttttcccaagtaagccaagggcatgatttctgtggtacattttatttaaca

SEQ ID NO: 60 - DNA, 2195 bp, Homo sapiens
ckwkkttacttcagacatgggacggtctctgtagttacagtggggcattaagtaagggtgtgtgtgttgctggggatctgagaagtcgatctttgagctgagcgctggtgaaggagaaacaagccatggaaggaaaggtgccaagtggtcaggcgagagcctccagggcaaaggccttgggcaggtgggaatcctgatttgttcctgaaaggtagtttggctgaatcattcctgagaaggctggagaggccagcaggaaacaaaacccagcaaggccttttgtcgtgagggcattagggagctggagggattttgagcagcagagggacataggttgtgttagtgtttgagcaccagccctctggtcccctgtgtagatttagaggaccagactcagggatggggcttgagggaggttaggraaggaagggggctttggatcattgcaggagctatggggattccagaaatgttgagggaacggaggagtagggggtaaacaaggattcctagcctggaaccagtgcccaagtcctgagtcttccaggaccacaggcagccttaagcctggtccccatacacaggctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctytggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccg

SEQ ID NO: 61 - DNA, 1662 bp, Homo sapiens
ckwkkttacttcagacatgggacggtctctgtagttacagtggggcattaagtaagggtgtgtgtgttgctggggatctgagaagtcgatctttgagctgagcgctggtgaaggagaaacaagccatggaaggaaaggtgccaagtggtcaggcgagagcctccagggcaaaggccttgggcaggtgggaatcctgatttgttcctcagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctytggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccg

SEQ ID NO: 62 - DNA, 1149 bp, Homo sapiens
gggcatccgtactttaatgactatgtaatattcgactcaggactatactgtaacttatttaggatctttcggcctttaggttatttatagtattttgctgttgtaaaatgactttcatatagctgtcttaggcataatatttgtctgcctctaattatttccttctaggtttgtacaagtgtgattattagttaaaacatacttggcatacctccagaagccagggcacttggtagtttatgattgcaccaggttttcaggttaagtctataaataatgaagagaggaaggaacatagaactgccaactagaagtaaacaggctcgtgatctggtgacctgagcgactctgaatgcttgctgagtcctagttggcatctaggttggttcccatgtttgagagacgaggatggtgaatttaagccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttaaaata

SEQ ID NO: 63 - DNA, 1461 bp, Homo sapiens
  - (1)..(1461): "n" can be any nucleotide 'a', 'c' , 'g' or 't'
ccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagtttgttgaagaaacaagtcatttgcatctgtgtggcgttgttgaacatggtcctctctcctggccactacatcacattcagagttgattctcccctccctgttcagagactggtggtgggtgttctttatccggcatctctctgtgacagcagcagcatttgtggccataattggcctaaattcatgaactcattagagagtgcagaaaggtcacagcctgatacattcatgagatgcaattcattaaagagcaacttctccccagcaacttttgggtttgactcgtggtatcatcttcctccgcgaggtctttgttaatcaccagcttgccgtgtctcaggtagttcagcacaggcccaaagtaggtggggtctctgtcgattaaataggcgcctgtttcatcctgcccaaggagggaaagatgccccagcncgccatgcctctaagatgggtgaggagaggtggccaggaagccagcgggatgctgcgggccgggcgtgggggtgctcttcttcctgcgggcccggcgtgagggtgctcttcttcccacgggcggggagtggggttgctcttcttcacgcgggtggggtgtgggggtgctcttcctcttcttcctggctttcccgtgtgtcccacggcttacacaaccagcacagntgcgctcgattctc

SEQ ID NO: 64 - DNA, 765 bp, Homo sapiens
ctcaaatacacatcaccaaacaaattttctctattatttgggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaagtagtgttatgttcagatatttgcagaatttaaccttaaaccaagtttagaattgggaatggagaaaacctttgtaaaaattattttaaaatgagatcatttttaagaaaactataatgtaacaatgtcacatatttccttcttcaggctccaattcaaatcatactccaatttgaaaagaacaaaaattccacaaaacgttcattctttcctactttttccttacgttgtacaacaaatgtggaaagaaaaaaaaaacagaaaaagtgtatcccatcttaatgaaaatgactgcggcagtcaagagtttcaaatccagctgccaggggtgaaagcaaccctctgcatctctgaaagatttcatcagtgttatctcctttataatcataacttttcatgtgtatcatctgagtttcttattaaataatctcactataaaa

SEQ ID NO: 65 - DNA, 968 bp, Homo sapiens
  - (1)..(968): "n" can be any nucleotide 'a', 'c' , 'g' or 't'
ctcaaatacacatcaccaaacaaattttctctattatttgggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggtaactgatttattaaagttgattactaaatttttgtttgcagtgtgcatgtgtttgtgggctcatgaatttacatgctaatgtatgcaaattccattaaacaaccnaaatatggttgnagactactgctacagtaatttttgtgtattaatatttgtaatttttaaagttttcagacattcataatatttgtatattatatactaaagctattctcttaaggaaatagaaatgtttatgtttgcatgtttggg

SEQ ID NO: 66 - DNA, 2410 bp, Homo sapiens
tgggggggaaacctgcaaatcggatgatgccatacccttttccttctggtactggaaggttaaatgggtagcaagcagaaatgccttaaaccaaggattggtatattgattaaaacgctgatttaacagctcgcagtttccccttggaaacctggaaaagataagccagctgctgtctaagagtgctcagtgtccactgagagtacactatctatcatcacaatatggtgatgagaggtgttttatgtttgtgttaatttcccccactaaatcagtaattattacaatcctgtccctgctgtttaccctgcagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaac

SEQ ID NO: 67 - DNA, 798 bp, Homo sapiens
gcgcgcggctccgatgggaagcatgacccgggtggcgggacaagacttgcttcccggccacgcgcgctcggccggccgtggggcggggcataggcgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagggaactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaaggtgtgtatgactcttgagtaaagtattttctttgtgtgcaaggatggcccttccctgttaggaaaatgtcttctgcatgtgtaatcactggcttttccgaggtgactggaagctaataag

SEQ ID NO: 68 - DNA, 877 bp, Homo sapiens
gcgcgcggctccgatgggaagcatgacccgggtggcgggacaagacttgcttcccggccacgcgcgctcggccggccgtggggcggggcataggcgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagggaactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaagggtaagtgtcaactcctatttgagaacatttgcttaccccgaattaacatggtattcaaagagtattttatctgggattaccc

SEQ ID NO: 69 - DNA, 1349 bp, Homo sapiens
gcgcgcggctccgatgggaagcatgacccgggtggcgggacaagacttgcttcccggccacgcgcgctcggccggccgtggggcggggcataggcgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagggaactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcagaaaaa

SEQ ID NO: 70 - DNA, 538 bp, Homo sapiens
  - (1)..(538): "n" can be any nucleotide 'a', 'c' , 'g' or 't'
ggtcggtggcgcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaaggtcagaaagactcctgtttatggagggggttgcagcagagccacctactcaagggctgtgtgagcagtccagcatgttaggaagcagggaccatgt

SEQ ID NO: 71 - DNA, 3308 bp, Homo sapiens
gcagaggccgggctgagacgtggccaggggaacacggctggctgtccaggccgtcggggcggcagtagggtccctagcacgtccttgccttcttgggagctccaagcggcgggagaggcaggcgtcagtggctgcgcctccatgcctgcgcgcggggcgggacgctgatggagcgcgccatcagcccggggctgctggtacgggcgctgctgctgctgctgctgctggggctcgcggcaaggacggtggccgcggggcgcgcccgtggcctcccagcgccgacggcggaggcggcgttcggcctcggggcggccgctgctcccacctcagcgacgcgagtaccggcggcgggcgccgtggctgcggccgaggtgactgtggaggacgctgaggcgctgccggcagccgcgggagagcaggagcctcggggtccggaaccagacgatgagacagagttgcgaccgcgcggcaggtcattagtaattatcagcactttagatgggagaattgctgccttggatcctgaaaatcatggtaaaaagcagtgggatttggatgtgggatccggttccttggtgtcatccagccttagcaaaccagaggtatttgggaataagatgatcattccttccctggatggagccctcttccagtgggaccgagaccgtgaaagcatggaaacagttcctttcacagttgaatcacttcttgaatcttcttataaatttggagatgatgttgttttggttggaggaaaatctctgactacatatggactcagtgcatatagtggaaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaaaaactctggatatatatcacgatatctaactgattttgagccaattcagtgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttctctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaattaaaaaa

SEQ ID NO: 72 - DNA, 3503 bp, Homo sapiens
gaattccgggagcccgcggaggctgctgcagcagcccgaaccggcgtccgagtccggggaaggcccccgcgagcgcagggaggggccggaaagttccggcgaactgggggagcggcagtgggagagcgtcgggcgggaggcggtggtcctgggagcggccccggcgcccgaagccgccccgagctggtggggagggtcccggccggtggggccgggctggcgggggaggggcgcctgggggtgcaagaggcgaattggctgcccggggtgcaggagggacaggtggtgcgggctgtcaggaaacctacctgaacgggaaggagccccaggagggagagggacccggcgagggctcaggacccggaggcgccggcggaggaggaggtggtgactggcaggcccgggccccacggtacctccggggctgaaggggacgcaggatgtaggggcatggggagtcgggcgcagaagagtgcggggaacgctgagctctgggagccactgcctgagggcaggccgcggccggcgggaacctcttctgccgtctcagcctgggcgtcgctgaagctgtgtctgcggggaggcagcggaaggcggcagaggctgggaggcggcagaatgcagccagaggaggggcacaggctggctgctggagctgctgtccgaggtgcagctgcaacagtacttctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagcccacctcagcctgcyttcttcactcagaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggcctgcccagtatctgaaggtggagcagctcttcgggctgggtctgcggcccagagggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagtgctgtccctgcacactttggttcagtcccggtgcccctgccaagatgtggaaggggccgggtgaagacaggcttgagggccgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaa

SEQ ID NO: 73 - DNA, 2544 bp, Homo sapiens
  - (1)..(2544): "n" can be any nucleotide 'a', 'c' , 'g' or 't'
gccaaatggtgcgacaggaggngctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctaggtatgtgtctgagattttaagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagctgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacggagtctcgctttgtcgcccagac

SEQ ID NO: 74 - DNA, 2324 bp, Homo sapiens
  - (1)..(2324): "n" can be any nucleotide 'a', 'c' , 'g' or 't'
gccaaatggtgcgacaggaggngctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacggagtctcgctttgtcgcccagac

SEQ ID NO: 75 - DNA, 1396 bp, Homo sapiens
gcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggtacttaccgttgagtatgtgtgtggacttctgattaagacccagggtggtgatcatccatcatgaatcccagagacttccaaaacgagtcaagctaataaaaaggatgaaggacttaaaaactgcccttgatttgggagaagggaggccggagggaaggatgataattagcattttgcagagcttagaatgtcacctgtgtgggtattttataaatgccttttcattataataggagtcatatatagatacatttagtcatcgatttatcaatcccgttttgacatgttcactgtttaactacattaattatggggtggaagctctcaaatacattgcgaagtctagaaaggctaaaacagaggagaggagggtcctattgtttgggacacagacccaggataaaggggaagcctgagaatgtgccatccttcagatggaaagatgccatcacccacacacataatcactggggtgtatacttaagttgcttttctgacataatgaggtggggtagagaaaccctttcccttcccatcactcccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggcctaaaaa

SEQ ID NO: 76 - DNA, 513 bp, Homo sapiens
gcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaagtgagtgtctcagctgaatgccaggctttactttgcaaatagtcattcctagctcatcttgaaccaaataaatgttatattccataagaaaa

SEQ ID NO: 77 - DNA, 2044 bp, Homo sapiens
tgtgtgaatctccagaaaaggtactttgggcctgatttggaatgttatagtttatacttaccgaggaagccacccttgctttcaggatggattgttagcagttccgttggcctcagacaccaacttgaactgatcgtcttggacatgtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattctatgtgtggcctaaaaa

SEQ ID NO: 78 - DNA, 934 bp, Homo sapiens
acggccattaccaatcgcgaaaccaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcataggtaagattagagaccagttatgtttcttttcagttgcaggactgtctattccaggaaccttgaaaattagtgcatgctccaatttttaggttgcctaagcattcatgggaagcaaatagattgctgcttctggatataaaggataaagttgccagaatttagcttctatctcttattctctcctacgtatccacaattatatcatctttgttcagtaggtaactgttctccaggctaaatgttgcagggaaatttgaaaaagggcccaccaatctttagatactgtgtcatgaaga

SEQ ID NO: 79 - DNA, 1032 bp, Homo sapiens
gcggccgcccgggcccgggcccgcgtcgggcgcctggctctgtacgcgagcccggggatctgcggccttcgtgccccccctcccgggaggagcgtggagcggcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagacagcccctctatggtttagatggcagtgctgcaaaggaggcaacagaggagcagtctgctctgccaatcctcacgtcagtgatgctagcaaaacctcggcttgacacagagcagctggcgtaaaggagagctggcctctgcttcacttttgtttcagctcagcaaaacagtccctcatctacgggatctggcaacacagagcattcctgcagctcccaaaaacagatctccatccagcacagacagacccagtccaacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaaggttagtgaataatgttggtctaaactctgtatcccaagatactcaatgtgtgtcattgtgtggcttcttattccttacttgagatgaaaatatttaaaagtagagctttttaggaacatgatttgacaattagaattttttccttacatggacaccagaccaaccatccagagtgttaatttg

SEQ ID NO: 80 - DNA, 2234 bp, Homo sapiens
ggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgagttgaggagaggggctgctgtgcagggtgtggagtaggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgacgcttgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggaaa

SEQ ID NO: 81 - DNA, 2608 bp, Homo sapiens
tagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgagttgaggagaggggctgctgtgcagggtgtggagtaggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgacgcttgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggaaa

SEQ ID NO: 82 - DNA, 1237 bp, Homo sapiens
cgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggaaa

SEQ ID NO: 83 - DNA, 1286 bp, Homo sapiens
  - (1)..(1286): "n" can be any nucleotide 'a', 'c' , 'g' or 't'
gaggggaccttaaaaattaccggccacaaaaagaaaataaatttaggaaaaattattggtttattttagggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaaggtaaattttttttatttaaaatgcaattcatacagttcttgttcatgcatgtcagtaccagttaaaaattacactccccttgttgttaaaagtgccttttgttataaaaaagttaaatatctggctagtgatcttcagagatcttaatctagaaccctgtgagctaaaggtaaggtggttatatatctagttttcccagagcagtagcagtttacacctcaagtgattttttttctttttttacctcaagtgatttttaaagtatctttttactctgagaagtccccattttatgctcanggtgtcagcaaattcctcaaaattgtgtgcaaaattttgtatgtttaca

SEQ ID NO: 84 - DNA, 752 bp, Homo sapiens
  - (1)..(752): "n" can be any nucleotide 'a', 'c' , 'g' or 't'
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaagtaaggaatcatgctactaagttgaatacaatgtaatatgattgtttaggagattataaaaaatcaagtggcttcatgaaactcccacagtaatgtntagcgtgcctgtgcttcacatctctgctaacactgtagtttcatactttaaatnactcagtt

SEQ ID NO: 85 - DNA, 1826 bp, Homo sapiens
cgagcgcggcgcccttgagctgcaccgcggcgcaggtttgcgagccgacttgtcagccggccaagaaaaggaagctccgtcccttcccgctcacccggcttccccaccccttgtactctaaactctgcasagggcgagcgygcggccackgakgcgccgaggaggagcgagcgccgccgggcagcggcgtgccctcgggggagagggcgccggakargagcggcggcgcggcggcgakggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgarggcatcactttctctgtgccacccttcgccccctcgggcttctgcaccatccccgagggcggcatctgcaggaggggaggagcggcggcggtgggcgagggcgaggagcaccagctgccaccgccgccgccgggcagyttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgygatactaactcggactctctgcagtcactgaaggaaatmatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggtaattacaacttgatatttctacatggaaatcaagaaactcggacccaacttggtgcaaagacggatctccgccgattctgacggctctccaggttttgtc

SEQ ID NO: 86 - DNA, 476 bp, Homo sapiens
gccggcggtggcgcggcggagacccggctggtataacaagaggattgcctgatccagccaagatgcagagcacttctaatcatctgtggcttttatctgatattttaggccaaggagctactgcaaatgtctttcgtggaagacataagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgcactataccattctctcgtagatgattcattccacccaccac

SEQ ID NO: 87 - DNA, 2131 bp, Homo sapiens
  - (1)..(2131): "n" can be any nucleotide 'a', 'c' , 'g' or 't'
gaattattgctttggaagaaaancttacatctccacaagaccttgcttcccaaataagacatgtcagaagatgctgataatcctcacttctgcattacaaatcgctcataggtgcatctgcaggatcttacttggatccagagtgctagctgcaaaagcttctgggaattgtacacttaactctgaagttttatctttaatataggaagtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtataccaatttgtaga

SEQ ID NO: 88 - DNA, 989 bp, Homo sapiens
gagaaatggcgtggcaggggacccagcgagcccagagggattttgccgctgcttcctctacccctgtatttcacgcagctctctaaattgactcagctccaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacgtgagttttgttatttttaaacttctggcagtgggagtttgtaagattggaaaaagaaaatgtgtctgtacttgagtaagaaaggctttctttgctttgcaattcctgcctcttaagattgtttatcctgccaatatgctacattcgatttcattgtcctcatggtagctttctgcttaaaaatcacctaaaaaccatatgatgtggaagtgatgaattttataaatatttccctagttagaaaatttaccatatttggttatcttgctccaaattgagagcttcaagaaagaaacaagacaaacaaagcccaaagccagaaaaaaaaaaaaacctacaaagcaccatgctacatttctttataatttagatttaatttagaatttattaatttaaaatt

SEQ ID NO: 89 - DNA, 1818 bp, Homo sapiens
gaattccgggccaggcatggtagcgcatcgctgtaatcccagctactcgggaaactgaggtgggagaatcgattgaacctggaagtggaggttgcggtgagccaagatcatcctgtcgcactccagcctgggcaacaagagcgaaactccatctcaaaaagaaaaaaaaagatatatatgtgtgacttacaggtacaggtaaagttgcttctggttttctggttgttgcatggtatttcctatgcagccacaggtctttattttcttacttaagtgcctccaacttcccataacacaaattaaggcatgatgaacatcctctctgtgctgaacatcctgtgtatgtcacttcagaagcctgtgtgacggtttctttagtctttatacctaggggtgggatttctgggtcataggacagtaatttatatttatttcactaagtattctctttctctggcttttgttacatattacctgtttgtcctccagaaaacttgcaccaatttacattcctaccaatagggtaggagagtgcacaatgggtggattctaactccaaatctaacacctcttcttttctttgtttctagcagccatggcaatgacaggctcaacaccttgctcatccatgagtaaccacacaaaggaaagggtgacaatgaccaaagtgacactggagaatttttatagcaaccttatcgctcaacatgaagaacgagaaatgagacaaaagaagttagaaaaggtgatggaagaagaaggcctaaaagatgaggagaaacgactccggagatcagcacatgctcggaaggaaacagagtttcttcgtttgaagagaacaagacttggattggaagattttgagtccttaaaagtaataggcagaggagcatttggtgaggtacggcttgttcagaagaaagatacgggacatgtgtatgcaatgaaaatactccgtaaagcagatatgcttgaaaaagagcaggttggccacattcgtgcggagcgtgacattctagtggaggcagacagtttgtgggttgtgaaaatgttctatagttttcaggataagctaaacctctacctaatcatggagttcytgcctggaggggacatgatgaccttgttgatgaaaaaagacactctgacgaagaggagactcagttttatatagcagaaacagtattagccatagactctattcaccaacttggattcatccacagagacatcaaaccagacaaccttcttttggacagcaagggccatgtgaaactttctgactttggtctttgcacaggactgaaaaaagcacataggacagaattttataggaatctgaaccacagcctccccagtgatttcactttccagaacatgaattccaaaaggaaagcagaaacctggaaaagaaatagacgtcagctagccttctccacagtaggcactcctgactacattgctcctgaggtgttcatgcagaccgggtacaacaagctctgtgattggtggtcgcttggggtgatcatgtatgagatgctcatcggtaagttgcatggtttcagaggactttttctgtgcatccatgacagacttttacattgataccagcctctgtttcaattggcagtgatctaagtgatttccctacttgtctttcaaagtgaattgttttagacagatgacacctctttcagtaagatgtatcccactccattcttgggcttactggcatcctgcaattgctttgctgatcattttttatgtttttctttctcttataccttcatcttctccatctagaagctcttttagtca

SEQ ID NO: 90 - DNA, 2732 bp, Homo sapiens
  - (1)..(2732): "n" can be any nucleotide 'a', 'c' , 'g' or 't'
ggcacgancggcacgagtcggcacgagcggcacgagtaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgaaaaaa

SEQ ID NO: 91 - DNA, 1416 bp, Homo sapiens
  misc_feature (1)..(1416): "n" may be any nucleotide 'a', 'c', 'g' or 't'
ggcacgancggcacgagtcggcacgagcggcacgagtaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttgaatcaatttttgcatttggaagcatttgactctgcagcgttagggaacgttttctgattgtgactggaagtgtcctcttctatgagcatagctttttcttatcgtcacacctttgactaagagcggccatataagaatcttgaagcctagatcattttgcttgcagtttgtattgcaacttgaccataaagacaaaattacactgaattcaaagcaacactcttaataaagctttcct

SEQ ID NO: 92 - protein, 434 aa, Homosapiens
MPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDEGDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEETLLQMTSVFSWILNLPSKEEVFAFLRIFEKNM

SEQ ID NO: 93 - protein, 232 aa, Homo sapiens [sequence omitted]

SEQ ID NO: 94 - protein, 209 aa, Homo spaiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIERVALAAGAATLPAVPSCPNPQHPGSGTTARHLQVGPYWPRLA

SEQ ID NO: 95 - protein, 454 aa, Homo sapiens
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSSYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 96 - protein, 82 aa, Homo sapiens
MENFQKVEKIGEGTYGVVYKARNKLTGEVVALKKIRLDTETEGVPSTAIREISLLKELNHPNIVKLLDVIHTENKNISLKEG

SEQ ID NO: 97 - protein, 118 aa, Homo sapiens
MTRDEALPDSHSAQDFYENYEPKEILGRGVSSVVRRCIHKPTSQEYAVKVIDVTGGGSFSPEEVRELREATLKEVDILRKVSGHPNISIQLKDTYETNTFFFLVFDLMKRGELFDLPH

SEQ ID NO: 98 - protein, 167 aa, Homo sapiens
VFLGRCRSVKEFEKLNRIGEGTYGIVYRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTGGCNLGQAWSLDGTW

SEQ ID NO: 99 - protein, 141 aa, Homo sapiens
MSSAGGVSRRLAAVRSTVLCRAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLRLPISGVCEGCREPG

SEQ ID NO: 100 - protein, 119 aa, Homo sapiens
VFLGRCRSVKEFEKLNRIGEGTYGIVYRARDTQTDEIVALKKVRMDKEKDGIPISSLREITLLLRLRHPNILPARAPWKGRSGGSIRGCRGLMWSSSLCWKCATTASWEEWWVQSPRCL

SEQ ID NO: 101 - protein, 756 aa, Homo sapiens
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESVKRSSNFMYLMGGFRCVKCDDKEYGIVYYEKDGDESSPILTSFELVKVPDPQMSLENLVESKHHNLPRSLRSGPSDHDLKPYPSPRDQLKNIVSYPPSKPPTYEEQDLVWEFRYYLTNQDKALTKILTSVIWDLPQEAKQALALLGKWNPMDVEDSLELISSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGG

SEQ ID NO: 102 - protein, 508 aa, Homo sapiens
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESVKRSSNFMYLMGGFRCVKCDDKEYGIVYYEKDGDESSPILTSFELVKVPDPQMSLENLVESKHHNLPRSLRSGPSDHDLKPYPSPRDQLKNIVSYPPSKPPTYEEQDLVWEFRYYLTNQDKALTKILTSVIWDLPQEAKQALALLGKWNPMDVEDSLELISSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVKIIFCLFSYYP

SEQ ID NO: 103 - protein, 140 aa, Homo sapiens
MGNAAAAKKGSEQESVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFR

SEQ ID NO: 104 - protein, 156 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEVKIPNSAFCERERVEMRHS

SEQ ID NO: 105 - protein, 520 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGEDDVVEQGVKGETSASIR

SEQ ID NO: 106 - protein, 284 aa, Homo sapiens
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGCLRPVWNIIGKAYSTDYKFMQQDTWEVPFEEISELQWLGSGAQGAVFLGKFRAEEVAIKKVREQNETDIKHLRKLKHPNIIAFKGVCTQAPCYCIIMEYCAHGQLYEVLRAGRKITPRLLVDWSTGIASGMNYLHLHKIIHRDLKSPK

SEQ ID NO: 107 - protein, 185 aa, Homo sapiens
MCGQRWIHNFTCLAFLFHTLKSGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 108 - protein, 83 aa, Homo sapiens
MAPPSEETPLIPQRSCSLLSTEAGALHVLLPARGPGPPQRLSFSFGVPVRPVGANGPPLTSGFLGGWAEASVQRGLWKCLLTE

SEQ ID NO: 109 - protein, 213 aa, Homo sapiens
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGTKFFRASCLWLAFISFPAG

SEQ ID NO: 110 - protein, 383 aa, Homo sapiens
MDEQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSEVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKCEELSLARRRLPRWSQTSYGGKQLGPWDP

SEQ ID NO: 111 - protein, 414 aa, Homo sapiens
MDEQEALNSIMNDLVALQMNRRHRMPGYETMKNKDTGHSNRQKKHNSSSSALLNSPTVTTSSCAGASEKKKFLSDVRIKFEHNGERRIIAFSRPVKYEDVEHKVTTVFGQPLDLHYMNNELSILLKNQDDLDKAIDILDRSSSMKSLRILLLSQDRNHNSSSPHSEVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKCEELSLARRRLPRWSQTSYGGKQLGPWDP

SEQ ID NO: 112 - protein, 201 aa, Homo sapiens
MAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYNHDFFWSDPMPSDLKGMLSTHLTSMFEYLAPPRRKGSQITQQSTNQSRNPATTNQTEFERVF

SEQ ID NO: 113 - protein, 125 aa, Homo sapiens
MATSRYEPVAEIGVGAYGTVYKARDPHSGHFCALKSVRVPNGGGGGGGLPISTVREVALLRRLEAFEHPNVVRLMDVCATSRTDREIKVTLVFEHVDQDLRTYLDKAPPPGLPAETIKVSGVGRH

SEQ ID NO: 114 - protein, 45 aa, Homo sapiens
MATSRYEPVAEIGVGAYGTVYKARDPHSGHFCALKSVRVPTHLSF

SEQ ID NO: 115 - protein, 160 aa, Homo sapiens
MGVCPGKTPFCSPKPQGLARGHWSRRRDICVTGPLPLEPRAVYCKDVLDIEQFSTVKGVNLDHTDDDFYSKFSTGSVSIPWQNEMIETECFKELNVFGPNGTLPPDLNRNHPPEPPKKGLLQRLFKRQHQNNSKSSPSSKTSFNHHINSNHVSSNSTGSS

SEQ ID NO: 116 - protein, 300 aa, Homo sapiens
  - (1)..(300): "XAA" can be any amino acid
MPRARMPXPRAHSKAGCPCGCPRDPLTLLSPSGHIRISDLGLAVKIPEGDLIRGRVGTVGYMAPEVLNNQRYGLSPDYWGLGCLIYEMIEGQSPFRGRKEKVKREEVDRRVLETEEVYSHKFSEEAKSICKMLLTKDAKQRLGCQEEGAAEVKRHPFFRNMNFKRLEAGMLDPPFVPDPRAVYCKDVLDIEQFSTVKGVNLDHTDDDFYSKFSTGSVSIPWQNEMIETECFKELNVFGPNGTLPPDLNRNHPPEPPKKGLLQRLFKRQHQNNSKSSPSSKTSFNHHINSNHVSSNSTGSS

SEQ ID NO: 117 - protein, 169 aa, Homo sapiens
  - (1)..(169): "XAA" can be any amino acid
MRMPRARMPXPRAHSKAGCPCGCPRDPLTLLSPSGHIRISDLGLAVKIPEGDLIRGRVGTVGYMAPEVLNNQRYGLSPDYWGLGCLIYEMIEGQSPFRGRKEKVKREEVDRRVLETEEVYSHKFSEEAKSICKMVSSWWPDATLKLVAPSLGLAPVCPQNSKQAEGTGV

SEQ ID NO: 118 - protein, 319 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLLPAPHDKHQWDCGDFCCWPRPCPQSVLGCRLAGLSWYFLCELCVNLLFLCLRREIVNPVFHYLNVVIY

SEQ ID NO: 119 - protein, 236 aa, Homo sapiens
MDETHPGYGKEVDLEFLVSPSLPCLLSFAGSARHLVPPDSNLFSKLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 120 - protein, 572 aa, Homo sapiens
MAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKTICDSSVSTHDLKVKYLATLETLTKHYGAEIFETSMLLISSENEMNWFHSNDGGNVLYYEVMVTGNLGIQWRHKPNVVSVEKEKNKLKRKKLENKDKKDEEKNKIREEWNNFSFFPEITHIVIKESVVSINKQDNKKMELKLSSHEEALSFVSLVDGYFRLTADAHHYLCTDVAPPLIVHNIQNGCHGPICTEYAINKLRQEGSEEGMYVLRWSCTDFDNILMTVTCFEKSEQVQGAQKQFKNFQIEVQKGRYSLHGSDRSFPSLGDLMSHLKKQILRTDNISFMLKRCCQPKPRGSLPVPEPGCIPSVIAETQIDQNTLTDLNKVDPPP

SEQ ID NO: 121 - protein, 311 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGMLRLNYSLISFPVWKIPNTKDGR

SEQ ID NO: 122 - protein, 387 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGWATPLLSPAHSALRGCLGERNGSFLLATFLVSAWVKYSH

SEQ ID NO: 123 - protein, 516 aa, Homo sapiens
MRLELPAGHWERPDLELLEKSTQQGRAWDLELLEKGAGSLPLYVWKVSLSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 124 - protein, 171 aa, Homo sapiens
  - (1)..(171): "XAA" can be any amino acid
MALLPPFLASHRLEVSRDSGWLGQCWLQGVWERXPHSGLLYPLQHPPAEFSTYLNFCRSLRFDDKPDYSYLRQLFRNLFHRQGFSYDYVFDWNMLKFGASSSQAQPRDSPMTAKGPFCPRPCPCAGPTYSPTYWCPAPLGTQSPPDRPVEEVEELSPQNYWPVVWTPGPHF

SEQ ID NO: 125 - protein, 134 aa, Homo sapiens
MALLPPFLASHRLEVSRDSGWLGQCWLQGVWERGLTVAFSILCNTLQPEFSTYLNFCRSLRFDDKPDYSYLRQLFRNLFHRQGFSYDYVFDWNMLKFGASSSQAQPRDSPMTAKGPFCPRPCPCAGPTYSPTYW

SEQ ID NO: 126 - protein, 233 aa, Homo sapiens
MALLPPFLASHRLEVSRDSGWLGQCWLQGVWERGLTVAFSILCNTLQPEFSTYLNFCRSLRFDDKPDYSYLRQLFRNLFHRQGFSYDYVFDWNMLKFGGPLSCQPPALPCGRPQDELGCSPESRGCGPGAARTRTRGEDGAATGVRDPSPAPWPTHGGHCQPAPQCRRARGFHASLPHPAGWQYFSQSDLAGRPGEEGEYEAAQGCARQRLLLRPHWAARGLPDPSLTDKCAI

SEQ ID NO: 127 - protein, 243 aa, Homo sapiens
MAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKYVLAFYLLLN

SEQ ID NO: 128 - protein, 330 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLSCIQRTPYLQ

SEQ ID NO: 129 - protein, 246 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVGIFVGDFPFGFGFGI

SEQ ID NO: 130 - protein, 378 aa, Homo sapiens
MELRVGNRYRLGRKIGSGSFGDIYLVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERDAGDREERLRHSRNPATRGLPSTASGRLRGRRKVAPPTPLTPTSHTANTSPRPVSGMERERKVSMRLHRGAPVNISSSDLTGRQDTSRMSTSQIPGRVASSGLQSVVHR

SEQ ID NO: 131 - protein, 561 aa, Homo sapiens
MVEWWSALTCPLQTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEAQPLSSQPVASTSPPPRPSLRPLSLWPLRLLPLRPWADAAARPLLMVLLPLSATESLRDTVHQSSGVSNITTQLPLKQHFLQLRVTWGTCVTATQLSPACAVGQGIQRRLASWALLAWPRAWIVPGAPLRVSFCGRTVWLRLLAPSQFSETWLGPSTAACKGPCLLMQLLLNKNRALSWFESSMDVSSLVDCNLT

SEQ ID NO: 132 - protein, 213 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVALGGRAGPAHVSPHSVSQPPWAVCHQLSVISLGPWASVQPGGTRCNLTMVCWPAPSPGGGRHTAAPQH

SEQ ID NO: 133 - protein, 425 aa, Homo sapiens
MIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 134 - protein, 515 aa, Homo sapiens
MASRTPRNCAVLKGEVDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 135 - protein, 468 aa, Homo sapiens
MSARVQLTKSVPAIMRAMALRFAFTSCQISYSKAIPPPLPPPPPPHPPASRHPPCPHRHPRDKLTANETQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 136 - protein, 666 aa, Homo sapiens
  - (1)..(666): "XAA" can be any amino acid
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAVLTSEQLHDAEXFSLAGFNVSSQGVHFSPARSLPVAN

SEQ ID NO: 137 - protein, 458 aa, Homo sapiens
MKYTFWGWVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTL

SEQ ID NO: 138 - protein, 262 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGSPSRRGGRHASVPTTPQDLRSALQGRAGGQQGPGAALPPRPPGSARGLLTSQPRAEPSRAGVGGGRRPPCTLCGDYWPRPWPRAPQGAQRRPAAPPQTSWRVWRPGS

SEQ ID NO: 139 - protein, 203 aa, Homo sapiens [sequence omitted]

SEQ ID NO: 140 - protein, 244 aa, Homo sapiens [sequence omitted]

SEQ ID NO: 141 - protein, 222 aa, Homo sapiens
MVKLYLYQKNVKIAIFDLKSRQNFFVYFREEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 142 - protein, 409 aa, Homo sapiens
MRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVQSMPGSQLDSLGGTPPSSFLPSLWKHSGRGIWLSDSLASALSSLGLLELIRNR

SEQ ID NO: 143 - protein, 305 aa, Homo sapiens
MRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVFARTWVALSPSA

SEQ ID NO: 144 - protein, 780 aa, Homo sapiens
MASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQADQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACRLPPPFVPTLSGRTDVSNFDEEFTGEAPTLSPPRDARPLTAAEQAAFLDFDFVAGGC

SEQ ID NO: 145 - protein, 401 aa, Homo sapiens
MASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQADQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTH

SEQ ID NO: 146 - protein, 96 aa, Homo sapiens [sequence omitted]

SEQ ID NO: 147 - protein, 333 aa, Homo sapiens
MHRYFESPRRLLPVHFCCCQWRGGGVDFECLLGGVWDRCRKVLRAQECEWPRHLPSACLLSSACRGQPERRAAVVGAQDPTEPPRLSRSLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 148 - protein, 131 aa, Homo sapiens
MLKEFLEIPFPTSPECTLQPKSQQPTGKEAEEHPTSAPLTHSLLPPTPLWVVSHFIFDFRGETALHKAACQRNRAVCQLLVDAGASLRKTDSKGKTPQERAQQAGDPDLAAYLESRQNYKVIGHEDLETAV

SEQ ID NO: 149 - protein, 272 aa, Homo sapiens
MRGAARLGRPGRSCLPGPALRAPPRPPLLLLLALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDRYCTYFGKEKK

SEQ ID NO: 150 - protein, 344 aa, Homo sapiens
MPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSSYYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVGPLE

SEQ ID NO: 151 - protein, 141 aa, Homo sapiens
MEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 152 - protein, 106 aa, Homo sapiens
MELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 153 - protein, 50 aa, Homo sapiens
MVNLSHEDFEFISGTRMRKLAREGQKPPEGFMAPKAWTVLTEYYKSLEKA

SEQ ID NO: 154 - protein, 238 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQVC

SEQ ID NO: 155 - protein, 73 aa, Homo sapiens
MSDVTIVKEGWVQKRGEYIKNWRPRYFLLKTDGSFIGYKEKPQDVDLPYPLNNFSVASSVMFRYLQNLTLNQV

SEQ ID NO: 156 - protein, 213 aa, Homo sapiens
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKVTDLLKLITKFLFAVCMCLWAHEFTC

SEQ ID NO: 157 - protein, 352 aa, Homo sapiens
MGGKPANRMMPYPFPSGTWKVKWVASRNAFKPRIGILIKTLIYSSQFPLGNLEKISQLLSKSAQCPLRVHYLSSQYGDERCFMFVLISPTKSVIITILSLLFTLQLFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKYDEDGMDCMDNERRPHFPQFSYSASGRE

SEQ ID NO: 158 - protein, 132 aa, Homo sapiens
MELLRTITYQPAASTKMCEQALGKGCGGNSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKVCMTLE

SEQ ID NO: 159 - protein, 192 aa, Homo sapiens
MELLRTITYQPAASTKMCEQALGKGCGGNSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRVSVNSYLRTFAYPELTWYSKSILSGIT

SEQ ID NO: 160 - protein, 207 aa, Homo sapiens
MELLRTITYQPAASTKMCEQALGKGCGGNSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRLQGSQKNDLEYVEEDGHVVVRKQFPCGLLDWVEPEQAKAYSS

SEQ ID NO: 161 - protein, 337 aa, Homo sapiens
MSDKDLRTAAAGGGHLVAILTVFIPQKDLVEEEAEEAGVALRSTQSTLQAGLAADAWAAPIAMQIYKKHLDPRPGPCHLSWAWAWASWPAAACTAGPKGRPPMTQVYERLEKLQAVVAGVPGHLEAASCIPFPQENSYVSSTGRASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPKKVMNFRADVFTWADPPNPEVKVLMVRSSHGARVLSTLPAVGVGAHARWGEKEVALLF

SEQ ID NO: 162 - protein, 122 aa, Homo sapiens
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKVRKTPVYGGGCSRATYSRAV

SEQ ID NO: 163 - protein, 842 aa, Homo sapiens
MERAISPGLLVRALLLLLLLGLAARTVAAGRARGLPAPTAEAAFGLGAAAAPTSATRVPAAGAVAAAEVTVEDAEALPAAAGEQEPRGPEPDDETELRPRGRSLVIISTLDGRIAALDPENHGKKQWDLDVGSGSLVSSSLSKPEVFGNKMIIPSLDGALFQWDRDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFSTKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTVTVLF

SEQ ID NO: 164 - protein, 743 aa, Homo sapiens
MGSRAQKSAGNAELWEPLPEGRPRPAGTSSAVSAWASLKLCLRGGSGRRQRLGGGRMQPEEGHRLAAGAAVRGAAATVLLRLRDDLNVTRLSHFEYVKNEDLEKIGMGRPGQRRLWEAVKRRKALCKRKSWMNKVFSGKRLEAEFPPHHSQSTFRKTSPAPGGPAGEGPLQSLTCLIGEKDLRLLEKLGDGSFGVVRRGEWDAPSGKTVSPPQPAFFTQKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRACPVSEGGAALRAGSAAQRECHKVLEMFDWNLEQAGCHLLGSWGPAHHKR

SEQ ID NO: 165 - protein, 604 aa, Homo sapiens
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPARYVSEILSISYTKLLGHSYVLIIAGVLSLAFFPSSILKVVFCLLKK

SEQ ID NO: 166 - protein, 613 aa, Homo sapiens [sequence omitted]

SEQ ID NO: 167 - protein, 133 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGTYR

SEQ ID NO: 168 - protein, 153 aa, Homo sapiens
MLQVGVLRDRSPAGASEGFHVRGRWRTEDCHLRTKAIETLRVAGRHQLPDRSFISFGISSLQMVSSQKLEKPIEMGSSEPLPIADGDRRRKKKRRGRATDSLPGKFEDMYKLTSELLGEGAYAKVQGAVSLQNGKEYAVKVSVSAECQALLCK

SEQ ID NO: 169 - protein, 231 aa, Homo sapiens
MGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 170 - protein, 146 aa, Homo sapiens
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHR

SEQ ID NO: 171 - protein, 123 aa, Homo sapiens
MMEELHSLDPRRQELLEARFTGVGVSKGPLNSESSNQSLCSVGSLSDKEVETPEKKQNDQRNRKRKAEPYETSQGKGTPRGHKISDYFETAPLWFRWQCCKGGNRGAVCSANPHVSDASKTSA

SEQ ID NO: 172 - protein, 478 aa, Homo sapiens [sequence omitted]

SEQ ID NO: 173 - protein, 344 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARASQVSCNRVSSCVSKSSPGL

SEQ ID NO: 174 - protein, 336 aa, Homo sapiens
MFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKVNFFYLKCNSYSSCSCMSVPVKNYTPLVVKSAFCYKKVKYLASDLQRS

SEQ ID NO: 175 - protein, 198 aa, Homo sapiens
MPLAQLADPWQKMAVESPSDSAENGQQIMDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPEK

SEQ ID NO: 176 - protein, 489 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGNYNLNFYMEIKKLGPNLVQRRISADSDGSPGFV

SEQ ID NO: 177 - protein, 105 aa, Homo sapiens
MREFEVLKKLNHKNIVKLFAIEEETTTRHKVLIMEFCPCGSLYTVLEEPSNAYGLPESEFLIVLRDVVGGMNHLRENGIVHRDIKPGNIMRALYHSLVDDSFHPP

SEQ ID NO: 178 - protein, 413 aa, Homo sapiens
  - (1)..(413): "XAA" can be any amino acid
MYCFGRKXYISTRPCFPNKTCQKMLIILTSALQIAHRCICRILLGSRVLAAKASGNCTLNSEDFIFNIGSAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 179 - protein, 108 aa, Homo sapiens
MSKSKVDNQFYSVEVGDSTFTVLKRYQNLKPIGSGAQGIVCAAYDAVLDRNVAIKKLSRPFQNQTHAKRAYRELVLMKCVNHKNVSFVIFKLLAVGVCKIGKRKCVCT

SEQ ID NO: 180 - protein, 336 aa, Homo sapiens
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGKLHGFRGLFLCIHDRLLH

SEQ ID NO: 181 - protein, 415 aa, Homo sapiens
  - (1)..(415): "XAA " can be any amino acid
XRHESARAARVSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 182 - protein, 409 aa, Homo sapiens
  - (1)..(409): "Xaa" can be any amino acid
XRHESARAARVSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLNQFLHLEAFDSAALGNVF

SEQ ID NO: 183 - protein, 977 aa, Homo sapiens
MPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDEGDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEEVINLVDQTSENAPTTVSRDVEEKPAHAPARPEAPVDSMLKDMATIILSTFLLIGWVAFIITYPLSMHQQQQLQHQQFQKELEKIQLLQQQQQQLPFHPPGDTAQDGELLDTSGPYSESSGTSSPSTSPRASNHSLCSGSSASKAGSSPSLEQDDGDEETSVVIVGKISFCPKDVLGHGAEGTIVYRGMFDNRDVAVKRILPECFSFADREVQLLRESDEHPNVIRYFCTEKDRQFQYIAIELCAATLQEYVEQKDFAHLGLEPITLLQQTTSGLAHLHSLNIVHRDLKPHNILISMPNAHGKIKAMISDFGLCKKLAVGRHSFSRRSGVPGTEGWIAPEMLSEDCKENPTYTVDIFSAGCVFYYVVSEGSHPFGKSLQRQANILLGACSLDCLHPEKHEDVIARELIEKMIAMDPQKRPSANDVLKHPFFWSLEKQLQFFQDVSDRIEKESLDGPIVKQLERGGRAVVKMDWRENITDPLQTDLRKFRTYKGGSVRDLLRAMRNKKHHYRELPAEVRETLGTLPDDFVCYFTSRFPHLLAHTYRAMELCSHERLFQPYYFHEPPEPQPPVTPDAL

SEQ ID NO: 184 - protein, 540 aa, Homo sapiens
MNGEAICSALPTIPYHKLADLRYLSRGASGTVSSARHADWRVQVAVKHLHIHTPLLDSERKDVLREAEILHKARFSYILPILGICNEPEFLGIVTEYMPNGSLNELLHRKTEYPDVAWPLRFRILHEIALGVNYLHNMTPPLLHHDLKTQNILLDNEFHVKIADFGLSKWRMMSLSQSRSSKSAPEGGTIIYMPPENYEPGQKSRASIKHDIYSYAVITWEVLSRKQPFEDVTNPLQIMYSVSQGHRPVINEESLPYDIPHRARMISLIESGWAQNPDERPSFLKCLIELEPVLRTFEEITFLEAVIQLKKTKLQSVSSAIHLCDKKKMELSLNIPVNHGPQEESCGSSQLHENSGSPETSRSLPAPQDNDFLSRKAQDCYFMKLHHCPGNHSWDSTISGSQRAAFCDHKTTPCSSAIINPLSTAGNSERLQPGIAQQWIQSKREDIVNQMTEACLNQSLDALLSRDLIMKEDYELVSTKPTRTSKVRQLLDTTDIQGEEFAKVIVQKLKDNKQMGLQPYPEILVVSRSPSLNLLQNKSM

SEQ ID NO: 185 - protein, 689 aa, Homo sapiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKRDTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELHSLLEGLLQRDVNRRLGCLGRGAQEVKESPFFRSLDWQMVFLQRYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 186 - protein, 505 aa, Homo sapiens [sequence omitted]

SEQ ID NO: 187 - protein, 298 aa, Homo sapiens [sequence omitted]

SEQ ID NO: 188 - protein, 387 aa, Homo sapiens
MTRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 189 - protein, 314 aa, Homo sapiens
MGRCRSVKEFEKLNRIGEGTYGIVYRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLRLPISGVCEGCREPG

SEQ ID NO: 190 - protein, 314 aa, Homo sapiens; identical to SEQ ID NO: 189

SEQ ID NO: 191 - protein, 314 aa, Homo sapiens; identical to SEQ ID NO: 189

SEQ ID NO: 192 - protein, 887 aa, Homo sapiens
MGEAEKFHYIYSCDLDINVQLKIGSLEGKREQKSYNAVLEDPMLKFSGLYQETCSDLYVTCQVFAEGKPSALPVRTSYKAFSTRWNWNEWLKLPVKYPDLPRNAQVALTIWDVYGPGKAVPVGGTTVSLFGKYGMSRQGMHDLKVWPNVEADGSEPTNTPGRTSSTLSEDQMSRLAKLTKAHRQGHMVKVDWLDRLTFREIEMINESVKRSSNFMYLMGGFRCVKCDDKEYGIVYYEKDGDESSPILTSFELVKVPDPQMSLENLVESKHHNLPRSLRSGPSDHDLKPYPSPRDQLKNIVSYPPSKPPTYEEQDLVWEFRYYLTNQDKALTKILTSVIWDLPQGAKQALALLGKWNPMDVEDSLELISSHYTNPTVRRYAVARLRQADDEDLLMYLSQLVQALKYENFDDIKNGLEPTKKDSQSSVSGNVSNSGINSAEIDSSQIITSPLPSVSSPPPASKTKEVPDGENLEQDLCTFLISRASKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLVLTKTGKLFHIDFGYILGRDPKPLPPPMKLNKEMVEGMGGTQSEQYQEFRKQCYTAFLHLRRYSNLILNLFSLMVDPNIPDIALEPDKTVKKVQDKFRLDLSDEEAVHYMQSLIDESVHALFAAVVEQIHKFAQYWRK

SEQ ID NO: 193 - protein, 887 aa, Homo sapiens; identical to SEQ ID NO: 192

SEQ ID NO: 194 - protein, 351 aa, Homo sapiens
MGNAAAAKKGSEQESVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 195 - protein, 737 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEAPKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 196 - protein, 855 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVAVKMLRADANKNARNDFLKEIKIMSRLKDPNIIHLLSVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 197 - protein, 966 aa, Homo sapiens
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGCLRPVWNIIGKAYSTDYKLQQQDTWEVPFEEISELQWLGSGAQGAVFLGKFRAEEVAIKKVREQNETDIKHLRKLKHPNIIAFKGVCTQAPCYCIIMEYCAHGQLYEVLRAGRKITPRLLVDWSTGIASGMNYLHLHKIIHRDLKSPNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELIKREQAVEKKYPGTYKRHPVRPIIHPNAMEKLMKRKGVPHKSGMQTKRPDLLRSEGIPTTEVAPTASPLSGSPKMSTSSSKSRYRSKPRHRRGNSRGSHSDFAAILKNQPAQENSPHPTYLHQAQSQYPSLHHHNSLQQQYQQPPPAMSQSHHPRLNMHGQDIATCANNLRYFGPAAALRSPLSNHAQRQLPGSSPDLISTAMAADCWRSSEPDKGQAGPWGCCQADAYDPCLQCRPEQYGSLDIPSAEPVGRSPDLSKSPAHNPLLENAQSSEKTEENEFSGCRSESSLGTSHLGTPPALPRKTRPLQKSGDDSSEEEEGEVDSEVEFPRRQRPHRCISSCQSYSTFSSENFSVSDGEEGNTSDHSNSPDELADKLEDRLAEKLDDLLSQTPEIPIDISSHSDGLSDKECAVRRVKTQMSLGKLCVEERGYENPMQFEESDCDSSDGECSDATVRTNKHYSSATW

SEQ ID NO: 198 - protein, 459 aa, Homo sapiens
RKEAVLSAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 199 - protein, 1124 aa, Homo sapiens
MAPPSEETPLIPQRSCSLLSTEAGALHVLLPARAPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRAIRRTVRRALPRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLAHNTGALVAVKQLQHSGPDQQRDFQREIQILKALHSDFIVKYRGVSYGPGRPELRLVMEYLPSGCLRDFLQRHRARLDASRLLLYSSQICKGMEYLGSRRCVHRDLAARNILVESEAHVKIADFGLAKLLPLDKDYYVVREPGQSPIFWYAPESLSDNIFSRQSDVWSFGVVLYELFTYCDKSCSPSAEFLRMMGCERDVPALCRLLELLEEGQRLPAPPACPAEVHELMKLCWAPSPQDRPSFSALGPQLDMLWSGSRGCETHAFTAHPEGKHHSLSFS

SEQ ID NO: 200 - protein, 505 aa, Homo sapiens
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 201 - protein, 626 aa, Homo sapiens
MDEQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSEVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 202 - protein, 626 aa, Homo sapiens; identical to SEQ ID NO: 201

SEQ ID NO: 203 - protein, 372 aa, Homo sapiens
MAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 204 - protein, 303 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 205 - protein, 303 aa, Homo sapiens; identical to SEQ ID NO: 204

SEQ ID NO: 206 - protein, 590 aa, Homo sapiens
MELENIVANTVLLKAREGGGGKRKGKSKKWKEILKFPHISQCEDLRRTIDRDYCSLCDKQPIGRLLFRQFCETRPGLECYIQFLDSVAEYEVTPDEKLGEKGKEIMTKYLTPKSPVFIAQVGQDLVSQTEEKLLQKPCKELFSACAQSVHEYLRGEPFHEYLDSMFFDRFLQWKWLERQPVTKNTFRQYRVLGKGGFGEVCACQVRATGKMYACKRLEKKRIKKRKGESMALNEKQILEKVNSQFVVNLAYAYETKDALCLVLTIMNGGDLKFHIYNMGNPGFEEERALFYAAEILCGLEDLHRENTVYRDLKPENILLDDYGHIRISDLGLAVKIPEGDLIRGRVGTVGYMAPEVLNNQRYGLSPDYWGLGCLIYEMIEGQSPFRGRKEKVKREEVDRRVLETEEVYSHKFSEEAKSICKMLLTKDAKQRLGCQEEGAAEVKRHPFFRNMNFKRLEAGMLDPPFVPDPRAVYCKDVLDIEQFSTVKGVNLDHTDDDFYSKFSTGSVSIPWQNEMIETECFKELNVFGPNGTLPPDLNRNHPPEPPKKGLLQRLFKRQHQNNSKSSPSSKTSFNHHINSNHVSSNSTGSS

SEQ ID NO: 207 - protein, 590 aa, Homo sapiens; identical to SEQ ID NO: 206

SEQ ID NO: 208 - protein, 590 aa, Homo sapiens; identical to SEQ ID NO: 206

SEQ ID NO: 209 - protein, 676 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYSAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGMTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 210 - protein, 406 aa, Homo sapiens
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 211 - protein, 1142 aa, Homo sapiens
MAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKTICDSSVSTHDLKVKYLATLETLTKHYGAEIFETSMLLISSENEMNWFHSNDGGNVLYYEVMVTGNLGIQWRHKPNVVSVEKEKNKLKRKKLENKDKKDEEKNKIREEWNNFSFFPEITHIVIKESVVSINKQDNKKMELKLSSHEEALSFVSLVDGYFRLTADAHHYLCTDVAPPLIVHNIQNGCHGPICTEYAINKLRQEGSEEGMYVLRWSCTDFDNILMTVTCFEKSEQVQGAQKQFKNFQIEVQKGRYSLHGSDRSFPSLGDLMSHLKKQILRTDNISFMLKRCCQPKPREISNLLVATKKAQEWQPVYPMSQLSFDRILKKDLVQGEHLGRGTRTHIYSGTLMDYKDDEGTSEEKKIKVILKVLDPSHRDISLAFFEAASMMRQVSHKHIVYLYGVCVRDVENIMVEEFVEGGPLDLFMHRKSDVLTTPWKFKVAKQLASALSYLEDKDLVHGNVCTKNLLLAREGIDSECGPFIKLSDPGIPITVLSRQECIERIPWIAPECVEDSKNLSVAADKWSFGTTLWEICYNGEIPLKDKTLIEKERFYESRCRPVTPSCKELADLMTRCMNYDPNQRPFFRAIMRDINKLEEQNPDIVSRKKNQPTEVDPTHFEKRFLKRIRDLGEGHFGKVELCRYDPEDNTGEQVAVKSLKPESGGNHIADLKKEIEILRNLYHENIVKYKGICTEDGGNGIKLIMEFLPSGSLKEYLPKNKNKINLKQQLKYAVQICKGMDYLGSRQYVHRDLAARNVLVESEHQVKIGDFGLTKAIETDKEYYTVKDDRDSPVFWYAPECLMQSKFYIASDVWSFGVTLHELLTYCDSDSSPMALFLKMIGPTHGQMTVTRLVNTLKEGKRLPCPPNCPDEVYQLMRKCWEFQPSNRTSFQNLIEGFEALLK

SEQ ID NO: 212 - protein, 537 aa, Homo sapiens [sequence omitted]

SEQ ID NO: 213 - protein, 537 aa, Homo sapiens [sequence omitted]

SEQ ID NO: 214 - protein, 603 aa, Homo sapiens [sequence omitted]

SEQ ID NO: 215 - protein, 416 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 216 - protein, 416 aa, Homo sapiens; identical to SEQ ID NO: 215

SEQ ID NO: 217 - protein, 416 aa, Homo sapiens; identical to SEQ ID NO: 215

SEQ ID NO: 218 - protein, 418 aa, Homo sapiens
MLPEDKEADSLRGNISVKAVKKEVEKKLRCLLADLPLPPELPGGDDLSKSPEEKKTTTQLHSKRRPKICGPRYGETKEKDIDWGKLCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFYENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKCLHQISLYGKIVMSYGVKSEEDRSRWA

SEQ ID NO: 219 - protein, 1711 aa, Homo sapiens [sequence omitted]

SEQ ID NO: 220 - protein, 1711 aa, Homo sapiens [sequence omitted]

SEQ ID NO: 221 - protein, 415 aa, Homo sapiens
MELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTDSGRLRGTQEVAPPTPLTPTSHTANTSPRPVSGMERERKVSMRLHRGAPVNISSSDLTGRQDTSRMSTSQIPGRVASSGLQSVVHR

SEQ ID NO: 222 - protein, 1169 aa, Homo sapiens [sequence omitted]

SEQ ID NO: 223 - protein, 480 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASSTA

SEQ ID NO: 224 - protein, 1175 aa, Homo sapiens
QVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAGEVDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 225 - protein, 1175 aa, Homo sapiens; identical to SEQ ID NO: 224

SEQ ID NO: 226 - protein, 1175 aa, Homo sapiens; identical to SEQ ID NO: 224

SEQ ID NO: 227 - protein, 983 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDISTFRTTGDWLNGVRTAHCKEIFTGVEYSSCDTIAKISTDDMKKVGVTVVGPQKKIISSIKALETQSKNGPVPV

SEQ ID NO: 228 - protein, 496 aa, Homo sapiens [sequence omitted]

SEQ ID NO: 229 - protein, 433 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 230 - protein, 433 aa, Homo sapiens; identical to SEQ ID NO: 229

SEQ ID NO: 231 - protein, 518 aa, Homo sapiens
MSCVKLWPSGAPAPLVSIEELENQELVGKDGFGTVFRAQHRKWGYDVAVKIVNSKAISREVKAMASLDNEFVLRLEGVIEKVNWDQDPKPALVTKFMENGSLSGLLQSQCPRPWPLLCRLLKEVVLGMFYLHDQNPVLLHRDLKPSNVLPDPELHVKLADFGLSTFQGGSQSGTGSGEPGGTLGYLAPELFVNVNRKASTASDVYSFGILMWAVLAGREVELPTEPSLVYEAVCNRQNRPSLAELPQAGPETPGLEGLKELMQLCWSSEPKDRPSFQECLPKTDEVFQMVENNMNAAVSTVKDFLSQLKSSNRRFSIPESGQGGTEMDGFRRTIENQHSRNDVMVSEWLNKLNLEEPPSSVPKKCPSLTKRSRAQEEQVPQAWTAGTSSDSMAQPPQTPETSTFRNQMPSPTSTGTPSPGPRGNQGAERQGMNWSCRTPEPNPVTGRPLVNIYNCSGVQVGDNNYLTMQQTTALPTWGLAPSGKGRGLQHPPPVGSQEGPKDPEAWSRPQGWYNHSGK

SEQ ID NO: 232 - protein, 756 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 233 - protein, 647 aa, Homo sapiens
MRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 234 - protein, 647 aa, Homo sapiens; identical to SEQ ID NO: 233

SEQ ID NO: 235 - protein, 942 aa, Homo sapiens
MASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 236 - protein, 942 aa, Homo sapiens; identical to SEQ ID NO: 235

SEQ ID NO: 237 - protein, 452 aa, Homo sapiens [sequence omitted]

SEQ ID NO: 238 - protein, 454 aa, Homo sapiens
MSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 239 - protein, 1065 aa, Homo sapiens
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 240 - protein, 606 aa, Homo sapiens [sequence omitted]

SEQ ID NO: 241 - protein, 606 aa, Homo sapiens [sequence omitted]

SEQ ID NO: 242 - protein, 625 aa, Homo sapiens [sequence omitted]

SEQ ID NO: 243 - protein, 625 aa, Homo sapiens [sequence omitted]

SEQ ID NO: 244 - protein, 624 aa, Homo sapiens [sequence omitted]

SEQ ID NO: 245 - protein, 556 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 246 - protein, 479 aa, Homo sapiens
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKYDEDGMDCMDNERRPHFPQFSYSASGRE

SEQ ID NO: 247 - protein, 479 aa, Homo sapiens; identical to SEQ ID NO: 246

SEQ ID NO: 248 - protein, 479 aa, Homo sapiens; identical to SEQ ID NO: 246

SEQ ID NO: 249 - protein, 685 aa, Homo sapiens
MELLRTITYQPAASTKMCEQALGKGCGGDSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKKAAAALFGGKKDKARYIDTHNRVSKEDEDIYKLRHDLKKTSITQQPSKHRTDEELQPPTTTVARSGTPAVENKQQIGDAIRMIVRGTLGSCSSSSECLEDSTMGSVADTVARVLRGCLENMPEADCIPKEQLSTSFQWVTKWVDYSNKYGFGYQLSDHTVGVLFNNGAHMSLLPDKKTVHYYAELGQCSVFPATDAPEQFISQVTVLKYFSHYMEENLMDGGDLPSVTDIRRPRLYLLQWLKSDKALMMLFNDGTFQVNFYHDHTKIIICSQNEEYLLTYINEDRISTTFRLTTLLMSGCSSELKNRMEYALNMLLQRCN

SEQ ID NO: 250 - protein, 685 aa, Homo sapiens; identical to SEQ ID NO: 249

SEQ ID NO: 251 - protein, 685 aa, Homo sapiens; identical to SEQ ID NO: 249

SEQ ID NO: 252 - protein, 305 aa, Homo sapiens [sequence omitted]

SEQ ID NO: 253 - protein, 1115 aa, Homo sapiens
MERAISPGLLVRALLLLLLLGLAARTVAAGRARGLPAPTAEAAFGLGAAAAPTSATRVPAAGAVAAAEVTVEDAEALPAAAGEQEPRGPEPDDETELRPRGRSLVIISTLDGRIAALDPENHGKKQWDLDVGSGSLVSSSLSKPEVFGNKMIIPSLDGALFQWDRDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFSTKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 254 - protein, 743 aa, Homo sapiens; identical to SEQ ID NO: 164

SEQ ID NO: 255 - protein, 1036 aa, Homo sapiens
MQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCPPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGAGGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 256 - protein, 1036 aa, Homo sapiens; identical to SEQ ID NO: 255

SEQ ID NO: 257 - protein, 424 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 258 - protein, 424 aa, Homo sapiens; identical to SEQ ID NO: 257

SEQ ID NO: 259 - protein, 424 aa, Homo sapiens; identical to SEQ ID NO: 257

SEQ ID NO: 260 - protein, 898 aa, Homo sapiens
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVTWNQPEQGNGQPGQQPFHSKHVRVMMHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 261 - protein, 749 aa, Homo sapiens
MEELHSLDPRRQELLEARFTGVGVSKGPLNSESSNQSLCSVGSLSDKEVETPEKKQNDQRNRKRKAEPYETSQGKGTPRGHKISDYFEFAGGSAPGTSPGRSVPPVARSSPQHSLSNPLPRRVEQPLYGLDGSAAKEATEEQSALPTLMSVMLAKPRLDTEQLAQRGAGLCFTFVSAQQNSPSSTGSGNTEHSCSSQKQISIQHRRTQSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRKPFGHNQSQQDILQENTILKATEVQFPPKPVVTPEAKAFIRRCLAYRKRDRIDVQQLACDPYLLPHIRKSVSTSSPAGAAIASTSGASNNSSSN

SEQ ID NO: 262 - protein, 712 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHLEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 263 - protein, 712 aa, Homo sapiens; identical to SEQ ID NO: 262

SEQ ID NO: 264 - protein, 712 aa, Homo sapiens; identical to SEQ ID NO: 262

SEQ ID NO: 265 - protein, 740 aa, Homo sapiens
MPLAQLADPWQKMAVESPSDSAENGQQIMDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 266 - protein, 740 aa, Homo sapiens; identical to SEQ ID NO: 265

SEQ ID NO: 267 - protein, 1374 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 268 - protein, 729 aa, Homo sapiens
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERRLAYNEEQIHKFDKQKLYYHATKAMTHFTDECVKKYEAFLNKSEEWIRKMLHLRKQLLSLTNQCFDIEEEVSKYQEYTNELQETLPQKMFTASSGIKHTMTPIYPSSNTLVEMTLGMKKLKEEMEGVVKELAENNHILERFGSLTMDGGLRNVDCL

SEQ ID NO: 269 - protein, 422 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 270 - protein, 422 aa, Homo sapiens; identical to SEQ ID NO: 269

SEQ ID NO: 271 - protein, 465 aa, Homo sapiens
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGYPPFCSETPQETYKKVMNWKETLTFPPEVPISEKAKDLILRFCCEWEHRIGAPGVEEIKSNSFFEGVDWEHIRERPAAISIEIKSIDDTSNFDEFPESDILKPTVATSNHPETDYKNKDWVFINYTYKRFEGLTARGAIPSYMKAAK

SEQ ID NO: 272 - protein, 547 aa, Homo sapiens
MAEPSGSPVHVQLPQQAAPVTAAAAAAPAAATAAPAPAAPAAPAPAPAPAPAAQAVGWPICRDAYELQEVIGSGATAVVQAALCKPRQERVAIKRINLEKCQTSMDELLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 273 - protein, 547 aa, Homo sapiens; identical to SEQ ID NO: 272

What is claimed is:

1. An isolated polypeptide selected from the group consisting of:
   (i) the polypeptide encoded by the isolated nucleic acid sequence of SEQ ID NO: 2; and
   (ii) the polypeptide set forth by SEQ ID NO: 93.

2. A pharmaceutical composition comprising a pharmaceutically acceptable carrier and, as an active ingredient, the polypeptide of claim 1.

3. An inhibitor of kinase activity comprising the polypeptide of claim 1.

* * * * *